United States Patent 12,576,115 (BACTERIAL COMPOSITIONS FOR TREATING AND PREVENTING HALITOSIS) - sequence listing, part 28

SEQ ID NO: 47 - DNA, 4575038 bp, unidentified (residues 1,525,014-3,050,026 of 4,575,038)
  source 1..4575038: mol_type = genomic DNA; note = Lentilactobacillus buchneri
cgccagtcactgcactcgttgtgaagattcccattgcggcaccggttgcgtataagattgtttttaagttcatattgatgatctcctttttggtttcattttttagtgaatcgattttgttaagttgaaatgtttgttgaagtgctgcttgatgatttacctttgtttgaatggctgatgtggcattggcattgctcccttcgttattgattgtcactagattatcgttggcagcttaaacgcaacttaaaaacgcaaaccaagtgataaagttgcactttccttaacaaaatcgcaaacctttttagagagttgtaagttttgaacaaaaaaagtgtgcgccaataagcggttagccttccttatacactggaagctgcttattggcgcacagttctactagataacattcagacgcaaatcgagacaatcagtaccaactgggtttgtccccatccgtattcggttggttgacacccaaagagtggcgaattgcttggcttggatggttaatcaacttaacaaccaggtcggcaatactcttgcgcgagacttcggtccccttgaaaggttcacctttttcggtggtttcgtaactcacaatgtctttattcgataaccaggctggcctgataatcgtgtagtccaaatcggagttttcgactaccttggcagctgcggtatacggctcaagatagccaccgtcgagctgctgatggttccatttgccaaacgcaccgggaacttcgtcatagattcccaaagtcgaaatccaaatcaatcgttgaacgttggtccgatcgatggcaccgacaactgccttggcctggtcttcaatgtttttgccactcaaatttgcataaacaatatcaatgccgtcgagggctttgatgattgcctgtcgattggtggcatccccttcaatgacggtttcacgtttgggatcagcgaccgtgatccggttcgcctgccgcagaaacaacgttaactggtgatccgtttcatcgagcaattgtttttcaaccaacttcgcaatttgcccattagcacctaaaatcaatacatttgccataaatgattttccccttttcaattaggattcaactccactgtaacaaatttcaaacaaaaacgggtcgcaaatgtgcgatccgttcaagatttctctatattacatatcagttgctgtcagcccattcaaaagtttcatatcttctgcactaatcgtaaagtctaattgggtattattttcaatatggttcttgtgagttgccttaggtaatggcagcacgtcattttgcaggacgaacttaatggctaattgcgcgacgctcacgccgtatctgtcagcaatctttttaatgtctaagttctccagaatgccgccggtggcaagtggagaatatgcctccaccaagatatcattatcttgggcaaattgggttgtttcaggctcggtgtagccgacgaagtagcgaatctgatccaccatcggttgaacatcagcatgagccaaaatgttttgaagatcatggacattaaaattagaaaccccaattgccttcacttcaccactggcataaatatcctgcatggctttccagacttccacattggcttcatcatagttggtcgatccccgttcgccccatggccacggagcatgaattaggtacaaatccaaataagataggttcaaggccttcattgtggaacgaaaatccgcaatcgccccgtcataggacttggttgcggctggtaattttgatgttacgaagacgttttcccggtccacattcgaatcaagaattgcctcgccaacgctcttttcatttcgataggcttttgcggtatcaatgtgacgatagccagcctgaagggccatgctgacagcgtcgtaagtatcctggccgcccggaatctgccaggtaccaaagcccactttgggaattttaatgccattatttaattcataggtatcagttaaaatcgacatccaaatgcctccctttactttttagagtatttatattatgggctaatccggtggaaaaagtaagcaaaaagctttcagaactggtattttgatagtttataaacaaaaatgacattcaaattcatcaatgaatttgaatgccatcttagattatctctgcggcagcgtataataaagcttcaaagtatcgccatacctagctgttgtgttggcggcaattgtcgcctgcttgttgaagtaataaattggtgtagtcatcgtaccgtcagcattcttcaccgaaacgccggtcaaggaagccagtttgttagggtctgcaaacaaagcgttatcaaagactttagctggcacgattccctgggtttgacttgagaaaatcgtcatctgggcgtctatcaaaatcggataggtattgcccactagctgagatgggctaatttgttgaccggtattggtcagataataggcaaccggtgataggaagttggccttgatcggatcgacatagaccagatagtcctctgatccaacggtgaagttagccggttgattggttgggctttgggtggcactgatcttatacccggttggcacgttcttagtggccacatcacttagttgagtgctgttttggagaatatcccccagcttgtcaccatcggtcatggtagccccggcttttagatctgtcttttgaataatccatgtgtaagccccaacggactggccggctggatttacatagttaatcttgacgctgttatctttagttgcctgttgggaattaggagctgccacgccacctgaatagacccagccaacaatcgcggaatttttatcatcaatgactttatagtataaatattgttcgcgggtcttaacagccgcatcggtaattgtaaaggtgtcattggcgctatagctgctcatgtcaaattgtttggccttatactgtgaccatttgggatcgacccacagtgtgtatttctgtggattggtcaacgtgtagccggtcttttgcaaaggcaaattcgcatttaccattgtgttggccggattcaaaccaccggcaaaggtcccgtttactcgcccgccatagatccaaccacggtaaacaccattgaatgaaacaaccttatagtaaaccgcaccccgattagtcgtggcgacccggtaagcccggaaatactggctggaaagcttggagctgccatatcgctgcaacgtatacttagacgcaatcattcgggcaccgcgcagggtaccggctttggtgtaaagcgcattggtcccgttggtcgtcacgttacggttctgcggggctgtctgcatcacctggttggatgtgattctagcatatgatttggcactggcatcagtggttgttaattcaactgcggccactatcgcaactgctgccaggccaagatacaatgattttttgaaactcaaaatcatgaaattcactcctcaatatccttttgtcgcacaatttgtattaagttaatattaccattttgcaatttaatatggtactgttctcgggggaattaaccaaatcgactcgcggttgtaactcaagggacacaaaaagttggagataaactccaacttttttgatggtcttatttggtttgattgcagtacacaatggattggacaatgtctgatcaaatatcgcttagtttcttaatatataagtgaagcccattgacagaaacatatggaatcgtgggttgtttgtcgatatcactcttctttaataataactggctaaatccattagcggtataaaagtctctcaaatgtggttcattttttgcttcaagatacaacatggtaccgacgattgctttccaagcatgtttaatttcctcataagcaaggccaagcagttcttcacctgtgataacattttgatctttatacaaaaaatttttccccaactggccaagaagtatggaggaaacttcatagctgtcttgagcagttttgtaaccaatgggcattaacctttttttgaacacttttactcaaatggtgccagtttttcttggagatcgagagtggtttcgaagatatggaaaaatacccagctataactaattgcccctttattgacgtataaactagtgtcgttcgtgataaaccaatcttttcaaattgaatcgcagtatcgtgaataaagtgagccacatcatcatttataggcaaaaaagaagaaagctgctggcgaatgctatcttctgggtagctctctagcagctttcctaatgaaactacttcaaatgccatattctattttctcactttctgagcaaataacttatcgaactttttatggaattgctcagagttattgtcagtgtacctgtttactggttgggtaatcttaatatctactcgccgagaatgcacgaatgcttctgcgagcgcatgaccagatttgctggtaaacttaaaatcagtttggaaactttttgtggccatactatccctcttcacagccctatctgccatcatctgcctctaacataaagatacggttttaggaacgtaaagtcaacaaaataatcagtaaaaagttgcgcacaaaaactattgatttggaacaaccttaacatggtccttcttataagcaacgacaaccaccacaatgttgattaataccaacagcgtggtcatcaagaaaacgtatcgatagtccaaaatcccggcaacccctgatgccagcatggggccaacaaccgcccccattgcctggaaggactggttgtaactaaaaattcgactcaccgaacgggccggcgcctccagtgtcatgacggtttgagtaatcggcagcagtgccgcattggcgatcccaatcaagaatcgcagcacacccaacatcacaaccgtagtcacaaagaacattggaaagaagacgaccgccgagaagatcagcccagccaacaggattcgctcaggtccgatatgatcgcccaatctacctaaataaggtgctgcaaaaatcgtcgcaatcccgggcagtgccgcgatcaccccactggtaaaggctacgtttccatgactatgcattaattctttgacaaacaaactaataattgggttgatggaggtcgtggcagccatgaccagcattgatgaaatgatcattgcccagaccacgcgcttgtgagcgatccctcgaaaagcatccttcattcccgtcttggcaccctttttaattggggtgaagtcttctttaacaaagaaccaagtcgacagtgatgccagaaacatcatgaacccaaacatataaaatggcagccggtagccaaaaataccagaaagatatccgccaataatcggtccaatcagttgcccaccgacatttccggtcgtcaaagttcccatcgtcttaccgctgtcttcagttggaacttcactggcaatcagcgcgtaggcattattgatatatcccgagaaagttccctggataaaacgaataatgatcaggaaccagacattcggcgacaaccctgtcagtgtggcactaatcgtcatcccgatcgccgctctcagcagcattggttttcgaccggttttatcagccagatttccccacattggcgagacaatcgcctgactcaagaacacgcctgagaatgccagcccggcatataacgttaattgccacttggggaagttgcccatctcggagataaagagcggcagaaacggcattgacatactcgcgccggcaccggtggcaaagttgccgaaccaaagcgcccacatgtttttcttccattgtggtgttttcgatttcatcatttttcaagaccttactaaattcgaattttagatacaaaattcattatagccattctcattgtatgtggcaattatcattaataccatgacgcatttaccaacgagctttctcaaaaccattcaaaatggtgaatggtataatgtacgcaaactatttttaaggagaaaacgaatggacaaattagatcgcaaaattttaaatatcattcaagaagacggccgggcatccatcaagagcatcgctgaaaaatgtttcatctccgcgccatccgcgtccgttcgcctgcaaaatcttgaaaatcatgggttcatcaacggctataccgccaatgtcaattacgaaaagttgggctatttgatcaaagcatttgtccgaattgacgttagttacgttgaaatgcctaagtttgttgacttcatttcaaaaattcccaatgtggtggaatgcaactacatcaccggagacgcctcggttcagctgaaggttttctataaaaccatgaccgaactgaatgaattcaacgcgtctcttaaggagttcggctacagtcacacaaacgttgccttcacaacgaatattggccctcgcccactaaaactgccggaaaacgacgaatagtcaagagctgcaaaaagttttttattttcataggcaaaccggcaatcctgcctttttttcatgaaaaaataatcaaaatcacaaaatcatctgaaaacttcctctctaaaatgcccgatttagacaccgtggtgttagtataatgacaaattaattagaggcctctaatttgattcatcattaccaacagagaggaagtttattcatgcaaaaaacagaagtaactgaaaacgcagacggcacccgccgctccttgagcaaccgcaacgttcagatgatcgctatcggaggcacgattggaaccggcttattcttaggttccgggaccaccatcagtaaaaccggcccatcaattttattagtctatttagtgttaggtatctttttcttcttaatgatgcgtgccatcggtgaaatgctttattcagatccatcacaacacacatttgtctcattcattacccgatatttaggacccaccgtcggccactttaccggctggacttactggctgggactttcattttgtgccatggcagaaattaccgccatctctacatatgttcagttttggttcccaaatatcccgtcgtggctgattcaaattgtgttcttaggaacgctggcagctgttaacttaatcgccgccaaggtctttggtgaggctgaattctggttcgctttaatcaaaatcatcgcgattgtcgccttaatcgccaccggggtcttcatgatgtttacccactcgaccaccccacttggccacgcatccgttcaaaatattttccataacttctcaatgttccctcacggtggcttgagtttcatctcagccttcccaatggtcttctttgcctttcaaggaattgaatttgtcagcattaccatcggtgaagccgaaacaccgcatcgaatcatcaaaaaagccgttaacgaaacgctactgaaaattttgatcttctactttggcgctttaatcgtgatcatgggcatcatcccatggacccatttgacgcctgccagcagcccatttgtccaggtcttcaaattagccggcttcccggcagcagcagctgtcattaactttgttgttttgacatccgcttcatcgtctttgaacagctttatcttctcggctggccgtcacttctaccagctggctactgagacgcctaaggatagctttatgaaccgccattttgctaagatttctaaaaatggggttccagccgctgcgattggcttttccgcattgtgcctcttgattaccccgttgatgagtctgaccaacgccacggcctcagtctttacgatcgttgctggttcttcaaatgacatgtatatcctggtatacgccttggcaatgatggctcatcggaaataccgtgaatccagtgactttctgccaaatggtttcaaaatgccttggtacaatttcaccagccccctcaccattgccttcttcgccattatctttgtgaccttgttcttcatcccacaagatattatcggtgcggtcggtgccatcatctggacagttgtcttcggcggtgtaacctacctgcatcaacgcagtttggcggttgccgaagctcagaatgattaattgaaaaatggcattcgttttaatttcagatatgtcgttaaaataatcttttcaaccaaactaattgtcaaaagggtcaaaacatcatcaaactggtgttttgaccctttcgtgtccgattgcttagttgctcattcccattaccaacccggcaacgtacgggatcagccagaacagccatacaagcaagctgaacttgtggaaattgcgtttggacttttcactccccagccataaaacgtaaccggcccacagaaaatgaaaagccatcaagacaattgcggctaaaccagttaccaaatgcaggacaggcgtggcagcccccgaggtgatggcgatgattgcgacaattaatttgaaatccatgatgaattcctccataaagttgagttgtttttttgggagtgacatcgcgtcaccttttttaaataaaaaatggaacctgcagtttcgaagttccatcggatggttgctaacgctgattatctcgtcggaaatcaaccagctcatgcgtgatttctttggtacttggataaatttttcgataaatttgatgcaattgacgatacttttccacgttatccggctcaggtaaaaagacatctttgaactggataaaggtcttggcacactcggagatgtcatgataccatcccaggccaaccgcagccagcatggcagctcccagtcccggcccctgttcattttgcagggagaccactttgacattgaaaatattggcctggatctgctgccagaggggactcttggctccgccgccaatcgagatgactgtctcaaattggtttcctttcgcctcatacaaatccaaaatatctctgaaggaaaagataattccctccaatacggcgcgaacaaaatcgtggcgctgatggattccgtcaatgccgataaagctgccgcggatgtccgcatcggcgtatggcgcccgctcaccaacaatgtacggggcaaagagcaacccattagcgccgactgttgatttggcggcactatccacgactgcagtaaagtcctcgttttcggcaaaggtctttttgaaccaactcagtgaaaatcctgcggccaaggtaacgcccattgagtaataggcattgggaatggcatggtcctcgtattgaatcacgccatcataattggtttccttttggggttcatattttaaaatcactccggaagttccaatgctggagagcacctttgtgggtccgtcaatgccggcacccactgcgccacaagcattatcagcaccgccgccaaaggttttggtgtgggtggataatccagaatattctgcgtaccactcattaatattccccgtctcatcaatggatctgactaatggcggacaaatcttctcgggaatatcaaatgcatctaaaatctctttgctccattgctgtttgtcgacatcaaacatcacagttccagttgcgtccgaggaatcaattgccaattgaccagtcattctgaaccttaggtaatcctttggcaataacatcgttttagcctgctgaaagatctggggctgattttccttcacccacaacagtttgggcagcgtaaagccttccaacggcttgttatgggtaatttctatgaaccgactacccattttagccatgatctcttggcgctgttgggtagaacgagtgtcattccaaagcatggctggacgcaggacttcattattgctatcgagcaagacgagcccatgcatctgaccggaataactgataccgacaatttggtcgggggtgagcttatcttttaaaatgagtcgaacaattgaaacagtcgtggcactgacccagtcttcggggtcttgttccgcgtaacccggttgtggctgttgtagtgggaaatccattccttcctgggcaatgatttcaccagtccgacttaccgcagttactttaacagagctggtgcctagatcgacacccagtacgcattcagtcatatcttctcctcctcgaaaaaaatgagaatgaaaaattaatcccattcccattaattattgtatttgatcaggatgttactttaaagtctgaatgatgtaatggttaattgtatctttaatctcttcaagatgatctgaatgagttgcatcgcgaagatctttttgagttttatccagtgaataattttcaagatctgccatacttgcttttccagattcaatatctgcaccaattcctgagtcaaatgaactatagcggtttttaacgatgtcatcaaggacgccgtcgtttttcattgcaacagcaactctcaagccggctgcaaagctatccattccgacaatgtggccatagaacaagtcatttggttcaaatgaagaacgtcgtggcttggcatcaaagttcaatccgccgcgaggtccaatactaccattttcaacaacttcagtcattgccgcagtcgtctcgtataagtttgaagggtattcgtcaatatcccagccaatcagcttatcaccttggttggcatccaatgagcccaacaaaccggcttctcgagcaactcggatttcgtgttgataggtatggccggccaagttcgcgtggttaccttccaaattaagcttgaagtctttatcaaggccatattctttcataaaggcaatcgtagtggcagcatcaaaatcatattgatgagtggttggttcctttggctttggttcaagcagcatttgtgcatcaaaaccaatttcgttggcgtagtctttagccatatggaataatttggcagcatgttcttgttcacgtttcatatcagtgttccaaagtgattcataaccttcacggccgccccagaatacgtagttttccgatccgacacgcttaccaatttccaaactgtgctttaattgcgctgctgagtaagcaaaaatgtcagcatatggtgaagtaccggcaccctcaacaaaacggggattggtaaataagttggatgtgttccaaagcactttcattccagaagttttttggttttcaacgattttgtcaacaaccttgtccaggtttctattggtttcgcgaagcgtatcgccttcgggagctaaatcccgatcgtggaaacaaagaaagtcaacgcctaatttatcataaaattcaaatgcggcatccactttagccaacgcttgatccattgggtcagtgtacttgtcatatgggcgaatagccgttccatcaccaaacggatcgactaaccgttggtcaaatgtgtgccaataagcgaccgcaaagcgtaaccaatcacgcattttcttaccaccaacgacttcatccggattataatattgaaatcctaatcctgactttttctctccggtaccaacatacttaattttatcgacattccaataactcataataagcaagcctccaggctttgttagttagttagttggttatataaaccaacttacattttaaatttatcatgtcgcaaatactttttcaagctcttttaaaatatttaaatctatccagccgttttttcagcccgcgcctcgttaagagaaaacgaatgtgttgaatgaatgttcttttaagtgagcctcgtatgttttgcccttaacatcaatcgagatgtctcgatcatggttcatactattagacatcaccacaatgacactaccatcggtattctcataagcagttgcttccccagcagcgtggccgccatacgaaagcaagtgagcacctggtcgaacgtaatgtgcgtaatgcttcataacgtaatattcagggttataggtcgtctgaccagtctttgaatcaaccgaaatcatgctgttctgtaaccaaccccaagtgctttcaccatcttgtaagacagaattccagtacatatatgcgttcacaccattactgatatagtgacggaataagttaaagacgtattccccataagtccaagtattgttaccattgccacattcagattctgactggaaatagttcaattccgggaatgcttgtacagtccgttgaagaacagacttgcctgcccattgataggtaacccctttaatataccgataagcatcgggctctgaaagaaccgtttcagtaatgactggatagtcggtggtttcatccttggtcatttcagtatcttcgagcggcgagttgatagttcctaaccagatgtcggtattcaaccctgctttttcaaaagttggcccaaggtaattcttgatgaagtcacgtaactcctcaccagtccagtagcatgaaggaaatttctgatctcgttgaggctcattttgtgggaacagttggctaatgtgaattccttcagtctcatatgcctgaatgaactttacaaagtaatttgcatatgcttgttgagtcttcttatcatgtttcaagattccataattgtacacgggttttgtcttcatccatgtaggcgggctccatggtgaagcggaaaagacgatgtctggattccgtttttgggcagctttgatatatggaattaagtatttcttatcacgctcgatggagaaatcttttaactcataatcgcctggtgtttcatctaatgaataccaattcaaagcatagtcactggcaccaacggggatccggcaaattcgataattttcaccctctccgggtttgaacaaatcgtccaaaatctcgttacgcttttcttcagataggctttgtagtgcttgccagcccaactcgttaaatgtttgaccaaagccccaaatttcttgacgtttctcggtgccaacttcgagattattatggagcttctcactcgtggtgctcaactgactctcaaccagttttgaatcttgagtactttcgatttgtgtagcagtcatgaacgttttcacctctatcgtatatttgtccttacattaattagagtaatccttggttcataaggactaagggccaaggattgttaaaactgtccttatttggcattctcttcttgaaccttaacatcacgatgttcattaacgaagagaatcataataccaccaacgagggcaagacctgcacataccgggaagattccaaaatagctaccgtgtgaagctgtgacaattgcagcagccacaatcggtccaataatttgtgaaccagtattggccaagttcaggattcctaaatccttagcagctgtttgtgggtttggtaatacttctaggttaagtgcctggtcgaccgcgaagaaaattcccattcctaatccggcaagcaatccataaaccaccatagtccaaggattattacttaacatcgggaaggccaccccaacagcaaccaagaatgcggcaataaataccgggatctttcggctcttcatccaatcggatacaggtccagcagtaattgacatgataatcgcagttaccatcagcatcatgttgatgatggaaatgtacttctgttggccacccgtatttaactgaatgtaatcactcaaaatgtacaattggtaacccataattgctgtagttgcagtgttaatcaacaattttccaaatagagctaagtaaaaatcttttgcctgatgtaatgggaaaataaagttttgaacaaccattcctgctgtaaaatgcttcttaggcattcccaagcttgaaggctcacgaacgataattgcagcaattggtcctgaaagtaatgttagaaaagccatcacaacaataccagtaccaacgtggctcagaaattgagccccaacaacttgaccaccatattgtccaatcacatatccaaaagcataaatggaagaaatcgttccgcggttcttaggggccacttggtcttgtaaaaaagcaagcaatggcgcaacaatcgcattcaaacaaacttgatacgagcaccaagcaaccaccatcattggcactgtcgttaccatattgaaccacagcagtgttaataaacttccaactgatccagcaattatccacggtgttctgcgaccaaactttgatcgcgtaatatccgagaatccgccaataataatattcgctaacgttgctgcgatcatggcagcagaagcaagtaaagcaactacctgagctttttcattaggaataatctgctgaacttttgctggaagcaaaaccccattaacacccaaatagggtcctaaccacagcagtgcgccaatcccagtggcaatcccaattttaattggtttcttaggttgttcactatctaaaacagtgccatgccattctggaacattttcattttgtgccattttattcaccttttccgttcattagaatatcttcaataatcgtttgtcgtcttaaaacaaataattgaagccgcttacaattatcatcaaaaaaattagctgattgcaacaatcactaacggtcgtcaccgccacttatctttggtacacgaatcatcacatatgcaattaggccagaacgctatcaccttaaaaagcgcattcattatcagttacttgaaacgctttcagaaaagttgatccttaattaagtacatggttagtttatcttttaaacaaacttaccgatatgcttgtatttgacatttattggacattatttgtcatctaatatttaaaactggattttagtttgcgcaaaatcgccacaattagtttggaatactatcgataaacaaaaaagtaagtgggtttcagttcacacatcccacttactttcacttatcttgtatatctattatcaatcaggctccaaatcgtcaaataatacgatttgattgactccttgatgtagctgagaaaaaggaccgataattcgctgacttaatccggtctttttatcaatgccattattaatagttaaagcggacccatctgggttatcaaaaactgcatcagccagccgcactttcccgagcgaacgcgttttctgaactggaacacaagtgttgaacaattcctcgggaacgttgagttgtaacacgatatgcgagtctacgctggttagcttcaactttgcatcccaattacgtaatcggatattgttctgttcttctgaaaatgcatcagcatcgccaagatacgcattgtcgttgatatagactggttgtcggatggtttcaaacaactcaacatcacccggtagtctttgctcaaccgccgcaatatattccttcattgatgttggactaccatcgtactctgcagttccaatgtgattgtcgtcttctgaaacgtcagtctcggcgacgaacaaattgttaaaataacgatcatctccgccataaacacaggcataaccctttattatagtagtatgtggctgatggtaaggagtcgtccggttgaggaccgactgaattgcgacctcacccgcaatgagattgttaacatatgcaccaccttgcgaatattcattaatagccacttcagagagcaacacattatcatctaccaaaaatgggccatgattgacttccagcaataaatcacgtaggttatcaaagtatatattccgagacagccgcgtcccttgagcctgccaatccaaccatgttcccaatgtgcagtgatctatcaagttgtgctcaactctaacatcaattggtgcatgcagcttgattccggcaatttcccaaccaccaaattcatatcgtgtaccaatgttataaatatgattgttagaaatcgttgagaaaataccgcccagaaaaccaataatcccagcctgtccacaatcatgaatttgattattacaaattaaatgggaaccaatatgatcttgatcccagttgttatcatatgctttaaacatcgtttcaatttgatactgatatcctggtcgatcatggtaccttgcaaattggttctgttgtcctttcgacaacgggtaagatccaagactaattccacaacacttagaatcatgaatatcgttgttgtggcagacccatcgagataaccatgcctaaacgcgcgatcacgatcgctcgaccggcacgcttatctcgataggactaaacgccacaatccgctcacttttttaggacagctccttgtggcagacccatcgagataatcatgcctaaacgcgcgatcacgatcgctcgaccggcacacctatctcgataggactaaacgccacaatccgctcacttttttaggacagctccttgcagcagacttaccaatataatcatgcctaaccgcaggatcacgatcccgctagcggcacaattatattggtaagccaaacgctgcaatccgctcactttttttcattatgctataattcattcataagcttcacaaacggaggaaatgacatggctgttaccattacaagttacaatattgatgaagaaacggctgacgggcttgttcttgttgacttttgggccccttggtgcgggccttgcaaaatgcttgaacctgtccttgatcagcttgaacctaactacaaaggtaaaattaaattcggtaaactcaacgttgaccatcaacaagaaattgccgaaaagtataaaatcatgagtattccagcactagttttatttcgtgatgggaaggccgttgaaaaagtcaccggcttttaccctcaagacaagttaacaaaatatttggattccaaagtggagactaggtgacaaaatgaaaattgcggttgttgtcgatagttccgctaatattcctgaaaaattagttcgtcagtatcatttaatcgtgatcaatcaacccattctttttggtaatcatctttatcgagaaggagttgatttatcatcttctgaattctataaaagactcagaaatgataaaacagttcccaccgcctcacaagttgccatgagtgaaatgcaaggcgtctttaccgaccttgcccatcaagggtatgaggccgcaatctgtgtgggtgtttctggtgggcttagcgggtttattaccaatttgaaggctttcgcaccttccgtcaaggacttagacgtttatgccattgattcaatgatggcatgcgctgcagaaggtaaccttgccttacttgccgcggcccttgttgatcaaaactattcagttcatgatattttaaaacaagttaagaagttacaagaagcaacccattttctgcttgttgtttataatatgcgtgcgttatccaaaacaggccgtattatgagccgttctccattgattggagcaattttgggcacacgtacaatcctaacgtttaataaagccgggagattggcccttgtgacgaatgcccatcatatggataatgcgtttaaaaaagtgaaattaatgatggatgaaaaactattgaacagttcagttaagcaaagaattagtgtactggatgccaacaatagtgaattgaatcaggaatggcaatcggaaataagaaaccaatatcaaacggccacaattgaaactggtgagattggcccgtttatgggtgtccatacgggtgaaaagtcaatgggcatcgtttgggcgccagattggcaagattttcttggtagcgacgtgcactagcaaagcataattgtttgtgaacaacggcttcaactgaaccaaacgtttgacttgtgctaagatagaattgatgaattaaaaaattgggagatagtgaaatgatcacattaaaatcagaacgagaaattaaaggaatgcaaaagtctggtgccgttttggctggcatgcatattgggttacgaaagattattaaacccggaatttcaagttgggatattgaaaaatttgcgttacgttatttagctgaaaacaatgctaaacctgaagaaaaagggtttgaaggctatgaatatgctacttgtgtcagtgttaacaatgaagtttgccatggttttccacgaaaagatcttttaattaaagatggtgacttggttaaagttgatactgtggttagtgtggatgggtatatgtctgattcttgttgggcttatgcggttggcaatgtgagtgatgaagttaagaatttaatggatgtcactaaaaaagcgttgtatcttggaattgatcaagccattcctggcaatcgaattggtgacattggtcatgcaatgcagcattacattgaagacgaaaatggttacggtgatgttcgtgaattcgttggtcatggtattcagccaacaatgcatgaagatccaatggttcctggctacggtgatgcaggccgtggcttacgtttaaaggctggcatgacgatcacaatcgagcctatggttaatacaggtgattggcgttgtgatacttctgctcctgatggttggactgtcacaactatggacggcagtttaagttgtcagtacgaacacactttagttgttacaaatgatggtcccaagatcttaacttcacaggatcctgaatttgatgctaagtatttgttggagcccgattttgatgcaaaaaaattattaatctaagtattttggaacaaatcaaaagttggtttacttttaagtagccaacttttttgtattccggataaaacgaagtattaatgtaaagtttgagtagaaaagcgaaagtaaatcttttcagataaagagaaggccgataaccttctaattaggtataagagtcaaaaatttaggaggtaacggcatagaaattatggaagttttaaaggagagtcacgatttatgtgatgtggaaaagaatttaatgattcaataccaggcattgattgcagatgttttaggcaaagcatggataaattttgcagatgcccgtctccgggcagtagtcttaacagacggttcgcaagcgacctcacacggccccacgtcaacatcggaacggtaaataatgatcaaaaaaattaggctttaactagttagagccctatctactaaattttgatacatacaagcgaagacgaatacttggacaaattcgtgaattccggtatgatagtacgcgtgtagattaataacgaaatgaaacttttaaaatgaaatggtggcagcatgaataaacgaaatttagatgcaaagagaattgtaattaaaattggaactagctcgctgttgtatcaagacaccagtaaattaaatttgcgttcaattgagcgtctcgcgtttgtattgagcgacttaaaaaaccaaggcaaggaggttgttttagtttcttcaggtgcaattggtgtggggatgggacgactgggtttgtcaaaaagaccagatacaattccagctcaacaggcagttgcttctgtgggacaaggcgagttattaggcatttatgagcgtgaatttcagcactatggtaaatcagtagcccaaatgctactgacacgggatgtactagtgtatccccaaagtaaaaagaatgtgttcaacgcttttcaagagttattaaaaatgaatgtgatcccaatagtaaacgaaaacgatacagtttcagttgatgaattggatcacaaaaccaagtttggtgataatgatcagttgtctgccattgttgcaaatttaattgatgctgatttgttgatcatgttgtctgatattgatggcttttattcaggaaatcctttgtctaatccaaacgctgagttgtaccacacgattacaaacattgatgggtcgattattcaggctgccggcggtgtgggcacaaagtttggaacaggcggaatggttacgaaactaaaggctgccaaacgaattttgaaaaatcatcaaaaaatgatactggcaaatggcaagaatccacgaattatctataatattttggcgggcgatccagttggaaccctttttgaaccaaaagaagttgtcacgaaagaaggactagcatgatcacattaacgcagatgggtcaaaatgcaaaaaatgcagaacaacagctttcccaattatcaacaatcaaaaaaaatcaagttttgaaggctatggcacgagaagtacgaaaaagttcagatgctattttaaaagcaaatgcaattgacatgcaagatgccgaaaaaaatggtgttaaaaaagttatgttggatcgtttaaaacttgatgatgaccgtattgctagcatggcagatggcttggaagaagttgcgggattggccgatccaattggtgaagttctgaagggatggactaccgaaacgggattggatatttcccaagttcgggtaccattaggtgtgattggtatgatctatgaagcacggccaaacgtaacggttgatgcagctggattgacgtttaaatccgggaatgcggtcattttacgtggcggtaaagaggccattcattctaatcaggcgcttgtgacggcgctacgaactgccttaaagaccgaaacaattgcagaggatagtattcaacttattaccgatacttcccatgaaacggcgaccgctttaatgcaactgacagcctatttggatgtgttaattcctcgaggaagtgccaagtttattcaaatggttgttcaaaaggctaaagtcccggtaatcgagacaggggcaggtaattgtcatgtttatgtcgacgagggggctgatttacaaatggccacaaatattattgtgaatgccaaaacacaacgcccttcggtatgtaatgccatggaaaaattggtggtaaatgaggcagtggctgaggagctattaccaatggttgctaaagccttaaagccgtttaatgttgatttacgcggggatgaacgggcaaagtcaattttacccgatattagtttggcaactgaagaagattggggaacagaatacaacgattatattatggctataaaagtggttgatgatttggatcaggcaatcgaccatataaatcgttataataccaagcatagtgaagccattattacaaacaactatgcacacagcgagcaatttaccaaagaaattgatgcagcggttgtctatgtgaatgcatcgacccggtttacggatggctatgaatttggatttggtgctgaaatcggcattagtactcaaaaattgcatgcccgtggaccaatgggccttaatgaaatcacgtcaactaaatatgtgattcgtggaaacggacaagtacgaaaatagaaaaaagcttttggctggttagaattagctaactttgccaaaagctttttcaagtgaaactagtagttactaatttcgattaaattggcgtctgggtcacggacatagaaggaagtgagtttgccgtgagcgccagttttttgaactggtccttcaataatgtcgacataataactcttgagatggttaatcacttcgggaagtttgtctttaaccacaatgcaaaggtcagcagaacccggtgttggtttatcagcaacgggttcatgtggttcgtcgacaagctgaaagttaattttttgtttgccacaaagaacggcttttcgatcggcatcaaacgttaagattggcatgtcgaaaacttcatgatagaaacgcagacttttttcgatgtcagtaactgttaaaacaaggtgatcaatttcacgaacgttcatgatagaaaacttccttactaaagtatgattaatttaataacaatagtatagcataatctatatttgaaaataatttgagcaccagttaaaagctatccctgatgaaattgtaagcactatctttttaaaaagtgtgattggctggtgaattgccttagttgacggtgtttagacctttgtgatacggttgttattagttgttttaggaacggatagaaagtgagaattatgagtatattatcagtagcaaacttatcccatggatttgcggataaaaaattatatgacgatgccggttttgaactgaacaaacaagatcatatggggattgttggtcaaaacggggcagggaaaagtaccttaattaaaattttaacagggacaattttacctgatgaaggcagtgtgaagtggcaaaataaggtcacttatggttatttggatcagtatgcggatattccagatggcgataccctttatcaatttttgactacggcgtatgcccatttatttgccttgaaagataaaatggacaagtgctatgcggattatgctgaaaatttagatgatgacctattagaaaaagctggccgaattcaagaaaccttggaagccaataacttttatgatattgatacggaaattgctcgtgtcatgacaggtctgggtttggacgatattggtcgtgatcacattgtcagtgaaatgagtggcggacagcggtcaaagattatcttggcgaaactccttttgcagaatcctgatgtgttacttttggatgaaccgaccaactacttggatactgcacatattgactggctagaaaattatttaaccaactttacgggagcctttattgttatttcccatgattacgactttttgactgaaattacgaactgtatttgtgacgtagcgtttggaaaaatcacgaaatatcgtggtaatttcaaagccgcaatgaaacaaaaggatgcccgaaaagaggcccaattgaaggctttcgagaagcaacaggttgtgattgaaaaagctgaaaaatttattcgaaagaacaaggccggttctcattcgacaatggcgaagtctcgagaaaagatgttgtcacatctagatcggattgatccaccaagtgagaatttgcgttcacactttgattttccctatctggaaacaggttcacaaaatgccgtcgctgttaaaaagttggctgtgggttatggaaaacgtcaattacttgaaccagttacctttagcttgacggccggcgaaaagattgccttttctggatttaatggagctggtaaatcaaccttaattaaatcaattttaggaagaattccggctttaagtggcacaacagtcttttctccatcttctaaagtgaattatttcagccaagagttaatctgggataaccctgaattgaatcctttggaaacaattcaagaaaagtatcccacaatgttacccaaaactattcgaaccaaacttgcaaaatgcggaatcaatgcggctgatacccaaaagccaatgcacattttaagtggtggtgagcaaacaaaggttaagctttgtttgttggaattagttgagtctaactttttagtgatggatgaaccgacgaaccatttggatgacgaaacgaaagctgctttgagtgaagccttacaaaaattcaagggtaatttgatcgttgtcagtcatgaggacggtttttataccaactggattgataaagaattaaatgttgagaaattacggattgataaataaggaccagaaacgtaaaacggaacagagaaatttttctctgttccgctttttagttcattttgagatttggttaggtgggtctggataatcgaattaggggtcgattctgatactgtaagccgtgtctgtatgaaaccttggccaatagcacaaacaacgagcaataagatgagcaatccactaaatacgggatgtttagacttttttggcggagactggttaaccgttagtttagacgtatgccataaattgacaaagaagtttgggagataccaaatcaaaatgagatcaaaagcaataagtaaaaattgcagcacatttggcaaagtaaccaaaaccgaagaaattttgatcccaccggaattgtttgcataggggagaactgtcattgaattccctactttttgctgattataaaagtaggtgggcacatcccggataactctttgatcaattcccaaatcgttttgaaatttcagggtaagattgtttgtagtgtaagaagcttgtccataacgggttctggttttaatgttagtttgcttttttttcacgattttagccttagttggaatggtataagttgacgattgaaaaaagtcaaaggctaagggctcaaaatagttagtgtagctccattgggttaaacctatcaatactaaaagtactgtgattaaaagatctagatgtaccaagttatatagcacagttggatttcccaatttgaaatgggcaattccttttaaaataagacgaattaaataacttatggtaactaagagcgaaccaccaagaaagaggggtaaagatcgccaatcaacttttaaagatttgactgctaaacgatcatcatagcggtgataaattgttcttgtaatggccagattttcggacttagcccaggcttggtagtcattcttagttagtataatatgcttatcatcgcttgtttttccttgataaccggttatctttccgtacctgttttgaacgactgtaatttgatcaatcgtttttgtgccaacaggatgcacattttgaaaattatcctggcataaagataacccaaaaatggcaaacagaaaacatagggcatagataaactcttgttttaattttgtccacataaggtgagaccgtcactttgcttgaattgtaagctgttaaaagtttagcacacttttgtctacaattttcaactaaattggggaatactattaaaaacacaaaaaatctgaaattaagattatcatccgagtcatttccgaatgtaacttaattccagatttttaatttgatatttagaatttgccactttcaacatcacgaagataatcagcaaggtgtttgaagtaaacaggtgcgttatcaatcatgtgatgatggccaccgtttggtgttgtgactaaacgagaattaggaattgcttgtgccatccgttgtgcagatttcaatggcatggtttcatgttcaccaaaagttaacaaagttggcactttgatcttgtggatttgatcgcggatatcccattctttaagttttccagtcacaacaaattcattgtcaccttggaaagcgttgtaaactggaacagccattgtatccaccaaatgtgaaattgctggtggctgtttgcgatccacatagcccttatttaaaacttcaacaagttcttggtaacgggcattatgccagtcgccattcttttcacaatcgcgcatgaactgagcgtctttaggtgagagtgcctcgtcacgaatggcatcttgatgttcgagatattcatcaatattatcaaccatgctggaaataatggcacccttcaaatgactgccgtatttcaacgcatagagcatggttaaagcgccaccccaggattgaccaattaaataaaaatgatcaatgccgagtttttgacgaacttcttcaacttcactcaagaaatagtcataagtcaaatacttatcagctattttaggatctgaataatcaggttgatcagaataccatgaccctaattggtcataatagtgtacctgaacatttaacccttgtttctggagttcatcatgaaagttttcccagtattcatgattgccaccggggccaccatgtaaggctagcaaatgaattttgctatcttcaccgtctgtatgtgtccacaaatgataaccgttatccaatgtgataatttttgttccttgtttcaccagatcaccctatttcgttttagttaacccttattctagcaaaagaaccgcaactactcaatatttcggttccgattttgggcccgttttcgcattgtttttcgccaaaatccacctttgatgaattttggttcgtaggaaataataaacgcgtcgggattattatcctcaataaaactgtaaagatgttgttcccgttttcggggagttaaaatttcaaactcaaggcgagctccttcacgaccctgggcatttttaacggtgactccatagccttcagcacgaatggtttctgcaaattgcttactttcatcagtttttggtagaatcacattaacgtccaacaaccctaagcgcaatttatcttctagccaggtgccaaagtaaataccggccgcgtaaccaagggcataagcagcaatattcaatacattgttgagtttgcttaatactaagcttaaacccacaacgtaggtcacaatttcggcaattgatagcagggacgcccagaatttatatcccttcatttccaatagtgtgcggatagtattcattgtgatgtatgcaaaactcaaaacgaaaataagtgcgattaaaccataattcatgaagatgccttctttctttgaggattaatatggtgcagtataacaaaaataatgggaacccggcaaggtggaaaaatattttgccttgtttttcgattgcctaagttcttgttctaatggcaatcaattggtagaattaactcaaaattgcagacaggggacggttgctatcaaattcgattcaaaaatggttgaacaaaacttaattcaagctgggttagccatccaattgcatacgtttgatcagattgattccaccaatgctgaagcaaaacgtgtgggtcaacaaacaggcagaatcacgcagccgcaggtatttattgcgaatcatcaaaccggtggctatgggcgtttaaatcgcgatttttattcaccaaaagatagcggtctgtatgtgagttttttaatcccaatcgcggctgaaaactttaacccagggctgttgactacaatgactgccgtggctagtgtggaagccattgaaaaacatttcccggtccggttacaaattaaatgggttaatgatttgattttggcaaatcgaaaagtgggtggaattcttgccgaagcgatcacaaatccagtaactaaccaaattataggagttgtcattggaattggcgtaaatttaagcacaactaattttccggatgagcttcaaaaagttgctatttcactcagcaatcggccagatgccaaggatcaaacggcttttgtaaatgactttattactaacttttttaaccatttagaaacctatcaaactggtgatttcatgacccaatatcgaaaaaagtcttccgtaattggacatcatgttcgcgtacagtttcaaaataacacagtgacaggtgtcgtttcagatattgatgatgacggtgcgttgctattgcaaacggacaatcagaaattgaaaattaccagtggcgagatcattcacgtgcggccaataaatgaataaggacaagaaaacaggctgaaggaaaatcctccagcctgtttttaggttctgaaacccgtttagctacgataactaaacgattcaaaacgcaaactgtcaactatttaattggtaaactcattttgcacttgttaatttgtaacgagtactgcagttcttggttaccacgaactgtggtaccaaaatcagtggcatacacaactaaaccaagttgatggcctgccaacaagtgatagaaagtaggctgcaattcaaccgtcaagtcgtaaaaatcattggccttcagttcgtcaactttatagttatttttgcggttttgtaaattaatatgtccattcgtaatcatcttccaaggtgtggcttctttttgcaaagtgaactcgcgaagattatcacgtcgccaatcataagtaccacttaaagctttagaagccaaaatggttggattgacagttagtcgtttggcatccccaaaatcaaccaactggaagctcaacatgccaaatggttcgttaactgccacccgaatttgtaattgaacacgaccgtcaatataagtatcttgatcatattgactagttttgaaaattaagcgattatcacgcaaacggttctcaccagttgtatcgtggttggtggttaataaatcgcgttcccaaacatcaagatgcttcttatagaagtcaaacgtatcaggatctaggtgatcactgaatgaagcggcagcggttcggactggcactgtttcaggaactaattctttggcttcaaaattgaagatttggtggttatcctttggtgattgccagtcttcatacgtgttccaagtttctggttcaacgttatcttgaattaaaacgtctggaagtaactctttggcatgattttcaattccaaacagttcatgactaaaccaaagattcatcatatcagtgaaatccagtgaacgaaaggcattaatgtaaatgtgttggccctgatgcaagattaatttcttagcaacaggtacatcacgaagtgcgttccaaagattgcccacattacgaggcttgacgttccagtcatttaaaccgtggaccatcaccatgtcagctttgatgtttttaacgttattcagatagttccgtgtatcccagtagtgactgtaattaccagtcgtgcgatcctgatctttcgtcatggcggctaaaacttgatcaaaaaaggctttgatcttaagatagtcaccaggtttttgcatgcgactaaagacttcagttgcgagtacatccatatcttcaccttggaaggtatttggggcagcgactaaaccgccatctcggtagtaatcgtaccaacttgaaattgcggcttcagaaattgcagttttcaatccagctactccggtcgtagcagcggcagtggccaaggtaccaaggtaagaacggccggtcattgcaattttgccatttgaccaccaagctttaatcgcaatattatcggttttattggtgaaagccgtgcgattgccagctagccattcgataacggcaattgtcgaaacagtttcagagacggctccggtatcgcgaatcccgtctgagtctttagttccaattccagcggcataaacaactgcgaaaccacgtgtgaggaagtagtcgtttaaagtataaggggcttccatcgcaaaggtctcgtcagcttccttttgttcgcctgcaatttgacgttttgctggcaagggctttggttcgtcttgatagtgaatatcttcataggtcagctcattcggttctttttcctccagcggcacatccacgttgtgcatcattgcgctaccggcttcctcgttgattccttgattataaggactagcggtgtataaaacaggtgctttaaagccctgttcagtttgacgaggtcgaagaatttctaccttgagtaaatctcgtttgccatcttcatcggtatccaaaggggcttccacataaacaacatcgcgaattaactgatggggatcaaatacagcctgtgccttgccgttaaagaagaggggttctgtggcttgctcataaaatgacacaaaatagccatcttgcgttaatttatctaaataagtttgaccattttttgtgtgcgtacataaaagcaaataccaagcgtgtaacaggtcggctttggactggatcaagtcagaaacagtcggtagttgaatccgtttcatagcctgcaaaggttcgtcaagctcaaaatcagtgtcaacgtcaaactgcaaaagctgcaaagcaacacagtaaaagacctcattggtgattggttggttgctttccaaaaaatctcccagtgttgtggtgggggtagctaaataattatctaatttttgtttaaaaaccgtttcacttttggcttctaaaatagttttgtgtaacagcactttccaaactgcgagtggatcctctaacttatcaacagaatcatcgataaagtgaatagctcgtaattctttgagttcggttgcgggatccactgtttcaatagcgaattgattatttttcataatataaaaaacctccgaaaagttgtatggcaccaattatacgccaatataagtgaactggtgacatgtctgaaaactaatttaaatctagtaggtaaatatgttcttgaaccactttagttacgttttgaagaagtgcaatatttttcttttgtcctacgtagtaattttcgtctccgtttttggcgtaaggtatttcttgattaaattttgaaaaaagggctacttcgcactgttttttgatttgagttcgagaaaaagttggtactaagtttttgggacttgagccgtaaacaatatatccgccaaagcatagttttgcgccaactgattgatacaatctattggctggattatcgcttaacgtgtagatgattaattttccaccataagactttagttgtttttgtgcctccctcagtaaccgttttgcgataccttgtccttgataatctgggtgaaccgccattgtgtctagggttgctaatggggtatgtggttgtagattgtattcctttgttcgttttaaactatcctttaataaaataatatcggcaattccaattacctttccgtttattagtgcaactaatgacaaagatttgttatctggagcggcttctttttcaccagtgatttcatcgttaaatgcacttctcatatatgctaacgcccgacaacgtagccagatttctagcatgctcggttgaaacaatgtaattatgatttcagccatgaagattaccttctttctcagttttcaagaataaagttaaaaaataaggctggaaaactatttccaaaccttttgtgtctataattattgagagtcatctttttgtgctaattgactatgatgaataccataggtaaagtaaattaataaaccaaatgcaaaccagacaagggatgcaatccaagtttcagcggaaagggttgtcattagaaagatacataatagtccagaaataataggtaacactggataaaagggaactttaaatccatggttaggaatatccttacgttttcgtagtggaatgattccaaatgaaacaacggtaaaggcgattaaagttccgatattaactaggttggttaattgatctaagggaactaaaccacccagaatggcaattacaatcgtaacaatcgtcatggcatgcagtggtgagtgattttttgcactaacttcgccaagtgtttttggtagaaggccatcacgtccagttgagtacactaatcgtgagctactgtaaatcatggtgaccatcatggtagtcatccctgcaagggcacctagtgaaagtaaaccggccatccagttctgattaactgactgtaaagcaaaggcaactggatcagcaacgtttaattttgtgaaaggaatcattcctgtcaaaacaatagaaacgccgatgtacaaaatagtggcaataattaaagtaccgatgataccaaatggcatgttacgatcgggattcttaacttctgccgcagaagaggaaacagcatcaaaaccaagataggcaaagaacacagttgaagcaccctggaacattccctttacaccaaaaggtaggaaaggatgccagtttgttggtttgacgtaaaaagcacctacaataaggaaaagcacaataatggcaattttcacaacaaccatgatgttattgattcgaatggaagattttaatcctttagataagaaaaaggcaatcaaacatacgataataacggccacaatgttgatgtaagttccatgagcaggatcaaatggaccagataaagcctgaggaatgtgaataccgaatcctgaaatgaaggaactaaagtaggcagaccagcctgtggatacagctgcaacggccaggacatattccaagattaaggcccaaccaagaatccaaccaattaattctccgaagatgacgttaccgtaggagtaagcactaccggcaacgggaagggcggaagaaaattcagcgtagcacatggcagcgacggaacagacgatggcagcaaccacgaaagaaagaataatggcaggaccagctttggttgcggcgacggttccgggcaggataaagattccggtaccaatgacggcaccgattccgagggcgattaaatcgccaccggaaatggttttttcaaaacgattgtcgcgttcaatgtaacgatcacgactttctttgcggaaaaggcgtccgcgtaatgacataaacaacactccctagatatagatgatcaaatttagttaacttattagactatatctagtaaaagattaaaagtcaatgagaaaaagaaagtgaacgaagcaaatcgataggtttagatagttaagcagggtggaagcgggatcgcaatcccgcgggaaccctgcttaactatctaaacctgatttgcggagttgtcctaaggcagtgaacgaagaagaacgggagtcagaagtttctaagcgtaatggaggcgggatcgcaatcctgcaggaattatgcttagaaacttctggctgttcttctgagttgtcctaaggctcaacgaggatcgatgtttctgcaagtaatagttagtgaacaggccttgagtactaatcatggtataatgtaaaaaattgttttgatgggaggggatcaagatcaagcaaacgttattaattgaggatttatcatctgtaggatcagtttcattaagcatagcgattccagtgataacggcatttggcatccagccaagtattttgccatctatgattctatcaacacacaccggtggttttggtaaacctgcaacgctgtctgtggcgaaaaacttgtctaaatttcaaaaacactggcatcaagcagacgtaggctttgagaatatattagttggttatctcggaagtgaaacgcaagtttatgaagagattcatttgctattggcggaaaatgcttcgaagttggtggtccttgatccagcttttgcggatcatggcaaattatattctggcatggcacaaggcgtggtggatgactatttgctactttgccgacatgcacaagtgctactacccaatttgactgaagcctgctttttaattggtcaaactgttcccatcactatagatgaacaacacctaaggattatattagaaaaattaattcaaaaaactgggatagacgatgttggcattactggcgttgaactaaacaatcaaattggcacagcatttttaagtgacaaaaactttgcctatgtatcttcagcaaaaatcagcggaaacttttttgggaccggagaccttttttcaagtttagtgtttgggtttcttttaaatggtgagacttttttaatggcattaaaattggcgaaccaatggacaagcgcggcagtaacagatactatcaaacagtcttcacgagattcacggatgggaattgttataccatcagttttatcaaagatattaacgtataaggggagttagagttatgcataataatcaattaagaaaaattgttgtgacggcgttatttgccgcgattatcttcattgggatttctgtttttcaaattccaattccggccttaatcgggaggccattcgtacattttggcaatgcattaaccgcattagccatcatgtttcttggttttggttacggaactttggctggtgccatcggtttaggattgtttgatgtgacccatggctatgccagtactgcctatctgacgatcctcgaggtcgttattgtggccgtggtagtgacactggtatttcggttattacgccgggatgatacaaaaaagtggcatattgtcattgtggcatttgtggtcggcttaacgaagatttttacttcgttcggcaactcgttgattgaaggtgtggcgtatcaaggtatgcagtggcacgcggcagttgttggcgcgattgcaagtgagccagccaccatcgttaattcaattacgacgtttgtgttagtgatgattctatactatccattaaagaaaattttaaatcgttctggattattgtaaaaaaattagaacaataacgcggtatctttcatgaaggtaccaaagttattgttctaattttattttggcgttagctattgccgatttatgcatcttgtaaattaccttgaatagccatgatagttttcaagttttgcacagcagattcaatggtaattccggttgcttcaaaattggggttggtcttatcgttggcgataaaaacttgtttttcagtgtcgagtgcgatggtgaaccaattgttactgtatttttcaaaggtcataataataactctccttagttttatttttttagttgaaaagatttcaaaaaatcaagaaatcgcttacatcaaactttatttttttattctacagcatgttacaataaaagacaacacatatacttatggagtgaaaaaattgactaataaaatcattgtaattactggtgcaactgggactggtaaaacaacagttagtgactatttaaaaacctattatcgcgtgccacaagtcattacgcatacgacgcgaccggcgcgtaagggcgaagtgaacggaaaagattattattttgaaacagatcgcagtttttttgataaccattatcttgaaaacgtcgtgtattcgggttatcattatggttcttcttatgaaggattggagattggttggcaacgaaatccgctagtcagtatcgttctcgataccaaaggtgccgtgacttatgagcaacagttgggtgagcaagtcgttgttttgtatttaactgtttccaatcatactaatttggtcaatcgactgaaaaaacgaggcgatgatactgaaatggtgcaaaaacgaattgcaagtgaagaatatcagcgtgatttgcaattgccacaggaattaaaaggaaaagcccatgtgatactaaatgatcattgggaaaacgcacgcaaacagattgatgtgattatgcaagaattaacaaattcggtagccaatcaataatctgtcatgtttgggctaattatgataagctttctaaagagtaattattactatttaaagttaggggaacaaacatggatacaaaagtagcacaagccattgaaattttacaacaaaaccattttaaaataacgaaacagcgacagacacttattgaaattatggcacaacatgaaaatcattatgtggatgtgacccaagtggatgaacaaatgcgatccaattatccgaagatgagtcataatacggtttatcgtaatttgaaggaattcgaacagattggtttagtggaacaaattattaaaggtgaacacgctcaggtaaaataccaatgtgatgtgacgcatcaacatcatcatcattttatctgtaccaactgcggcaaggttgaagaagttgaaatgtgtcctttagatttttttgagcgtcaactaccgggttaccaaatttctggtcatcgcttcgaactttacggcttatgtgcagattgtgcaaaaaaaattgggactgtttaaggctttgtttacaaatttaaagaattaatatggatttaatgtttagtctttaaaatgacagtgaatttgttaaagtttaactaaccatttaaaaaggggaggagaagaggctatggcatatcgaacgccaccatttattacaccatttgcaattgtaggtattttgattgcactgagtgccactaatgttgtggtaaataaggtgactggcacaacagacggtggagctgtgagtgcgcaaacagaatcagtcaataaggcttcatcatcaagcaagagtaataaagattcttcaaaaaaggaaagttcagatagtagcaaagaaagtagttccagcgaggatagttccagtagctcttctgatccaagtagttcgtcaagctctgatgcgacgcaaagtagttcgacggatagttcatccgcaaattctgcttcaagcacttattcaagcagtgcgtctacagccaaaaaggcaagtagttcagcagctacccagtcgtctagtgctgctagttcaaccactaaagcaagttcgtcaagtagtagcacccccacaactacaacgcaggataatacagacgattaattggaaggagtgatggaaattgtttacagtcattgatatgattaaccactatttagggtatattaatgtcaacttaaaactaaaaaaccggatttatacaattatcggatttgttggtaatttctatatgttgtacctggctttccgtttcttcgaaaatggtcgttgggtgcgaggtttaggatttattgcgatttttctgatttttctatatttcctgatcatgaatatctttttttatttcacaaaaaaggcaccgccatttgatatttcgcctaaaatcgaaaaattattaggtggaaaaccacgtgaagtttcagaaaatgaagagttacgtcaacgtttgcatcaacatgaacgtggtcgtcgcgcaattgtgccatcaactggtatctttgaaaaaaacacaattttacctgcgacaattaagtcgacgcaacgcgaagtatacaatattaatcagttggctgaacaaatgattcaaaataattttgcaatggcagattatgaaggcctttcggatgatgaaattattacgcatctgcaggattcaaatgattcagcagtttatgcaattggcgaaggaattccgtttccatattttgagctccgtgaagaaaacggcgaggcaaatatttatgcaggtatgaatcaaatgaatttataccggatcggtcacgttgctagtgtaggattgtctaattattttgatgcgaaaaaacagtatcggctttatctggcacaggccgttttgattggcggtcaacgtaaatttgccgggcgctcaaccttgatgaccgaggagtcaccatacgctgcaaaaattcaaatggcgtatcaaaaacgagataataatggaactcaaacaagacgtagatcgtactagattttggctattgtttgataaataaaaaagggaatctgttgaattgaccaaaattttgacaggttcttttttgtactttaaaattgatataatggaagtatgtattacagtatgtaatctggggatgaacacaaattttctggtattccaaccgcagagtgctaacgtaatacatagaaagaaaaagaggtaagactaatgtcaatgatcgaatttcacgatgtcgaaaagtactatggaaaatttcacgcactgcataatattaatttaacgattgaagcgggagaaactgtggttttaatcggtccttctggttcaggtaaaagtactttgattcgaacagttaatggtctggaacttattaatagtgggcaattaatcgttgatggctttgatttagccgacagaaaaacggatatgaacaagattcggaaaaatgtcgggatggttttccagcattttaacctctatcaaaataagacggtgcttgaaaacatcatgattgcaccgcgaattgtcttgaaacgtaatgaaactgagaataaaaaagtggcaatggagcttttagatcaggttggtttggcggataaagtggatagctatcctgcacaactatctggtggacaatcacaacgaattgcgattgcgagaagtttagctatgcatcctaagtgtattttatttgatgagccaacgtccgcactggatcctgaaatgattgatgatgttttgaatgttatgaaggatattgctcgcgattccagtatgaccatgttggtggttacgcatgaaatgggatttgcccgtgaagtgggagaccgtgttatttttatggctgacggtcggattttggaagatgactctaaagaaagtttctttgatggccagccaacaaatgagcgtgcccgtcagttccttagcaaaattattaagcactagagggggcattaagcatgaaaaaattaatacgttatttaggcttgctcacctcactgtgcttactagttttagtacttagtagttgtgggacgaaaaaagctgctaaccaaagtgttttgagccgcgccaagcaaacaaacacgattgtctggggagttaaagcagataccaaattgtttggactgatggatgttcaggattctcaaattaagggttttgatgttgacatggccaaagcaattaccaaacaaattttgggaccttcaggtaaagccagctttattcaggtatctagtcaaactcgaattcctctgttaaaaaacggtaatattgatgccgtaattgcaaccatgaccattaccccagatcgggaaaaggtggttgatttttctaatcactatttcaatgccggccagtcattgttggtcaaaaagggaagttcaatcaaaagtgtcaaagatttaaatgtatcgggtacccaagttctggcggtaactggcgctaattctgtagctaattttgaaaaagtagcgcctaaagctaaggttctggaattacaagattatgcccaagccttacaggcattgaaatctgggcaagggaaggcattaactacggataacggcatattgctagggatggcagttgaaaatcctgggtataaagttgtcggtggtgcctttacaaaagagccatatggaattgcagttaataaggggcaaaaatcctttgttaaccaaattaatgtggctttgaaagaacttcgtaaaaacgggcagtataacaaaattgttaaaaagtggtttggtaatatcgctggatttgactataaggaggcagaaaaatgattagtataatcgcaaatcattggcaagatcttctgtatggtttaggccaaaccctattgtgtagtattttagccctattttttagtttgatcatcggatcgtttttcgctatttttgaagtggtgccaagtaaaactttacgggtgatcgccagaatttatattgaagttttccggaacattcctttattggttattaccatgttcttttacgtggtcattcccatgttttttgtgaaggtaaatgggttcactgccggaacaattgggctaaccatttacacttcggcatttattgcagaaacggtgcgttcagggattcaatccgtggactctggacaaatggaaggctctcgcgcaaacgggatgacattcactcaagctatgcgttacattgttttaccacaagcatttagaattgtcattccaccattgggtaatcagtttattaatctggtgaagaattcttctgtacttgccttcgtagctggttttgatttgatgtatcaaggcaatacaattgcttctacaagttttgatacgttaaacgcgtattttgtggtgggtgttttgtatttaatcatcaccatgccgttaagttattacatgcgctatctcgaaaaacgattggattagggggtgaagaaaaatgcaaaactttattaatgcgtattcttgggttgacctccgttatttattagagggtctgtggattacaattgaagtttcggtcatctcgattgtgtttagctatattttaggtgctattctggggttgattcggtacattaaggtgaaatacttatctgccattgtcggctttatcattgatttaatccgaaatttgccactgctgttgatcatcttcttcacctactttgggttaccaaacattggcattcgtttaaatccaatttggtcgtccattttggcaatgagtattttcgagtctgcaatgttagcggaaattattcgaagtggtattggcgctgtagattcaggccaaatggagggtgctcgtgccaatggattaacttattggcaagctatgtggcatattgtgttacctcaggctcagaaaaaaatgattccaacgattgtaagtcagtttatttcgctgattaaggatacgtcattggcaacaattatcgttttgccagatttgatgtatcacgcgcagattatctatgggcaaaacagtaattacattttgccaatgtttttagccttggcagtgatgtattttgtggtctgttatctcctttcgattttgtcacactatttggagaaacgtttggcgtaaaaatttaaaaatattatcatatttttgtaacaagactcataatattaatttattatgagtctttttgttgtatctaatcatttgaaatttcctattgttaacgggattttggcgaatttatataaggcatagttgattgttaaatacaaaataagggttgaattttcatttagaagaactataatattatcaaatcttaattttattaattgttttctaattaattgctagaaggaggagtcagcgaagtatgggagaagaacttttaacgatcgatcatttacacacagcgttcaaacatgggactgaatattatgatgctgtcgatgatgtttcattgaaaatacataaagatgaaattctggcaattgtcggtgaatcaggttgtggaaaaacaaccctggctaaaagtattattggactacatgatttaaaaagaacaaaaatttctggacatatcgggtttgaaaatgaagaactagttggtgcttcacctgcaaagttcgataaattacgcggtagtgagatggggatgatttttcaagatccattagctgcgttgaaccccttaatgcgtgttgaagatcaggtgcgtgaagtgctggattatcatacaaattattctgcagaaaagaaacacaaaattgtgttggagttattagaccaagttggattggagaatccagaacgtgttgctcgtcaatttctccatgagctatctggtgggatgcgtcaacggattattattgcgattgcaattgcgtgcaaacctgaattaattattgctgatgaaccaactacagctttggatgtgacgatacaggctcaaattttggatctacttcgaacgattcagacacaaaaccatgcaggtatcattttaattacccatgatcttggagttgtggctgatacagcagatgaagttgtcgtcatgtatgcgggccaggtggttgaacgaggaagtgtttctcaaatttttaatcatccattgcatccatatacgcgctcattactgaaatcaattccacaagcagatcatccaggagatcgcttgtatgcgattgaaggctcagtaccaccattaacaaagatgccacatgatggttgtcgttttgcaccaagaattccatgggttcctgagagtgctcatgaaaagaagccaacaatgcatgaaccagaagagggtcactatgttttgtgtacctgttatcaaagttttaaatttgagaatggggaggccgtctaatgagtttagttgaaattaaagatttaaaagttcattatccaattcgttccggtttttttaatcgtattcatgactatgtatatgcggttgatggtgtcaattttgaaattgaaccggggcaaacgtacggattaatcggcgaaacgggatccgggaaaacgacgattggtcgttccataatcggtttggaaaaaataacatccggtcagattttatttaatggaaaagatgtttcgactaaacgagaacgaaaagccgttcattacaatcgcgatgtgcaaatgattttccaagattctttatcaagtttgaatcctaaaaaacgaatttacgatattattgcagaacctttgcgaaatttcgaaaaattaagtgatacagaagaaaagcatcgtgttcgtgaattactagatacagttggtttgggagatgacgaccttttcaaatatccatttgaattttcaggtggtcaacgacaacgaattggggtcgccagagcaattagtaccaatcctaagttagtcattgctgatgaacctgtttctgcgttggatctttcggttcaagcacaggttttgaattacatgcaagaaattcaaaagcaattcaatattagctatttgtttatttcccatgatttaggggttgtgcgtcacatgtgtgacagcatggcgattatgcatcgtggccgtttcgttgagttaggaacgcgggatgatatttataatcatccacaacatatttataccaaacgcttgttagcagcaattccggatatcaacgtggaccaacgtgaggttcatcgtaaacatagaaaagaagttgaaaaggtgtttgatacggaacaaagtaggtactatgacaagaacggacgagttttaccattgcaacagatttcagaaacacattcggtagctctgccagaagatcaagtgaagggggagtgagcttatgtggaaaacgattttacgacgggttgtaattatgattccgcaaattgtcattttgagtttgttggtattcattctagctaagttcatgcctggtgatccgtttactggatccatcacaccgcaaaccgatgcctctcagttacatgcgctgaaggttcaagcaggactgtatgatccttggtacacccagtatgttcattgggtggtaaatatgttccatggtgactttggaacaagttatcaattcaaagaaccggtcatggccgtaattggtggtcgtgcggttaataccttatggctgtcattattcacagttatcctaacttatctaattgccatcccactaggattactagcgggacgttacgaagatacaaatttggatcggggaatcatgttttttaactatgtgacgtatgccattccactgtttgttttcttggttctgggcctttggttgtttggctatgtgttagggtggtttccaagtggtggttccatttcactgagtgctaatggatttttcggaaatgcactaagtcgactttatcatatgattttacctggtgttttgacagccttactatcaacgacaagtaccgttcaataccttagaagtgaaattgtagatcaaaagcatcaagatatggttgcaacggctcgagcaaagggtgttcccgagcgaaaagtgttttcacgtcatattctaagaaattcgcttttgccaattgctgcatttatgggatattccattacaggcttgttaggcggttctgtcttcgttgaacagatcttcgtatatcccgggatgggacagctattcctaaactcaatcagtaatcgtgatttttcagtgatcacggccttagttatgatttatggaatcttggcattatttggaactttgttgtcagacatcattatgagtattgttgatccaagaattcggattaaataggagggagctaatatgacaaattcaaaggaaacacaagctgtcaaaactccatcaacgatgaaggtgatttggcaagaatttcgccatgatcgtgtggctatgttttcactggttttcacaattgtgttgattttaggtatttttatctatgcagcaagtttgaatcttgaaaaagtgacgaatgttaatatctttgcccagtatgataaacctggacaggatggttttcttctcggtgctgatgagggtggccgtgatggcctgaaaatgttagttattggagctcgaaactcaattatgattggttttgcggttacagttatttcatcactttttggaattatttacggtatgatttcaggcttttatggtggttggttggataacgggatgatgagaatttacgatttcatcaatattttaccggaaatcatgatcatcattgtgttagtcacaatcgtcccaaaatataattcttggacatttattatcatcatgtcttgctttatgtggctaagcaccgcccgattaattcggagtaaggcgttagctgaatcaaaacgtgattatgtttcggcttcgcgaacgtcaggtaccagtgattttaaaattttgtttcgggaggtcttacctaatttaagttccattattatcgttgatacgaccctaagttttgcaggaaatatcggaattgaaacaggattaagtttcttaggatttgggctgcctgacagtacacctagtttaggaactttaattagttacgcgcaggatccagatgtcattggtagtaagccttgggtgtggttaccggcggctgttattattttagttttgacactaagtatcagttacattggtcaagccttaagacgggcaggcgatgctcagcagcggcgtagttaggtttgtaaattcactgagagaagggatgctcaaattaaagagataaaagagttattcgttttactagaggaatgatgtaaaaaattacataaaaggggagatacgtatgagtaaaaaatggagcgtaggtgcagttgctgtattggcagcactcactttggcagcttgtggaaatagcaagtcagcctcaagtacaagttcaagcaaaccaacattgccacttagctattcatcaaagaaatcagcaattaagggtggtactttgaaggtcgctgaagttaacacagccgcatttaaaggaatctgggacaatgctttaaccactaatgttgaagatgcggacatgatgcagtatgggaatgaaagtctttttgcgacagataaaaactttaagattgttaatggtggtgctgctaacttaaaacttaaccaaaaagctaagacggcaactattaagattaatccaaaagttaaatggtcagatggcaagcctttagttgcccaggatgtggcttatgcctataaagttttagctaataaagggactgcttctcaatattatactgggagtattgcaaatattaaaggaattgctgcttatcacgctggtaaagcaaaagatatttctggtgttcagattaaaaacaagcgcactgtagttatccactttaaagtcatgaaacctggaatgaagacttctggaaatggttatttctgggaaaatgcggaaccatatcactatatcaagaatgtaccatttaagaaattggcaagttctgaccagattcgtaaacatcctttgttcttcggaccatttaaacttgcaaaagaagtttctggtgaatctgttaagtgggtaccaaatacttactactacaagggtactcctaagttgaaggaaattgatatgcaggttgtttcacctgattctattgcggctgctttaaaagcacataagtatgatgttacttatggacttggctcctcgacatatgggaaggttaagaacacctctgggtatacatttactggaaaacaggcattatcttatgattaccttggtttcaacttaggcaaatatgatgctaagactggtaaaaatgtgatgaacaagaactcaaagatggctgatccaagtcttcgtaaagctattgcttatgctatgaatattgatgctgttgagaagaaatttagctatggtttaggtagtcgattgacaacccttattccatctgctttctctaagtatcaagataagagtgctaaaggatttcctctaaacattaagaaagccaatgcacttttgaataaagctggatataagaagggtaaggatggttaccggactgatcctaaaggtaagaagttaacgattcaccttgctgaaatgcaggggaattctaacactcaagctattgttaagaactatattcaacaatggaagaaggttggccttcgcgtcaaattgactgacggccgtctcttggatatgaataacttctatgaaaaagttcaagccaactcaagtgatgttgatatgttcgaagctgcttggagtctttcaagcgagccatcaccaatggacttgtatagtgaaaatgcaccatttaacatgggtcgttttgtttcaaaagaaaatacaaagcttttgaacgatatcgattcacaaaaggcctttaacacaagctatcgtgttaatgccttcaagaaatggcaagattacatgaataaagaagctgcttacgttcccgaaactgaagttgttcaatcttacgcagttaataaccgtgttaagaacttcagtttgagtaatgcgactaaggactccaactgggccaaagttgaagtcacatctaacagcttatcgaaataagtttagccaacccctgaatgacacagctgttagatgaaaaataaataacctaccagagattaacttgatctccggcaggttatttttttgataataaatacgaattttatacggaatgatgattatgcaaataaataagcaaggccagcatcaaaatgccagtgagaactaaggacgccaaccaggctaatgaaccattagcgagtggtaaatgcatgttcatcccgtaaaagccactgacaatagggggaacggccaataagagcgaccaaattgtcaggaatcgcataatttcgttcaaattattattgatcaagcgatcaaaggtgtcacttaattgttcgacactttcagaaatcagcccaatcattcgatcggcttgattagtttccaactgtacgttatgcaatttacgattacattttttatcaaacgggacatccgtaccttgtggaattgatttaatttcttcaaagcaactggcattttcctggatagccgagcgaaggtacacagcatcttgattaatcaaagttaaatcatcaagatgtttcattttacttcttgcacttaaatgactttgaatttggtcggcttggtattccagttttgaaacacgaccgatatactttcgcacgatcggtaaaataagatctaaaaggaaagccatccgcttttcataactttgttgccacaacgattcaatggtttcattgatgacttccatttctgaactggtaaaaataaaaagtttatgatcataaaagattacagaaactggctcagaatgagacgaaccttttataggtgcccagaaaaccatgaggacataattattttccgtgccaatttcgatgcgtgccggttcgtccttatcatccacatattcaagcagaggtgcgggaacaccaaatttatctattatttgctgcttttccgattcactacaatcttgaacgtaagttaaatcaaatttatgtttttgatctgctgaatagctattgagcaatgtgagaacctccagtgttagacttgatttcgataatgatgcttacagtaataatatactggaaaaccaactaaaacaaatacaaaggagaagaggacaccaacaatgtcagattgaatttcgctgacaataacaaacaaagagccaagaatagccacaattggtgtaaacggaaatagtggtgtgctaaatggtcgctttaaatctgggttacgtttgcgaagaaggaacgcaccaacaaaggtcatgacatagaaacaataaacggtaaaaatacacaattcagatagccggtcagcgttgaaaaagagaatcatgatggccgaaattgagaccgtagtcaaaacagagataatcggtgtctgagtatttcggttgaggtatgaaagttgttttgcaaagggtaactcatgatcgcgggccatggcatacataattcgcggaaacgtcataattttgccgttcatacaacccacaatggaaatgatgatcccaatactcaagatttttccgccaatcgcaccaaagtctttttctgccatataaggaattgcaccaattcctagtttgtgaatttgagtggcaggcatgctccgaaaaacgccgaagcttactaacatgtaaattccaaggaccaatacaattcctaacgtaatggcttgaggtaggcgcttttctggattcttgatttcatcacctaggttagcaaccaaaatccagccatcaaaagcaaatagtgtggccagaattgccacaccgaaatttccagctgattgatgaacactggagaaagtttgtgcaaaggcgtcttctttaccatagaataaaccaaaccaaataagtgcaataacaggaactaatttgcaaattgttgtgacaatggcaaaagtggcaccgtatcggttggaaagaagattaaggccagcaacgagaacaaccgcaattagtgcaattggcaccgtccagttttgcggcatgtcaaagaaatcaacgaggagaatgccaaggtaagctgctagtgaagcaatcatggccggaccatagataatgatttgcatccagccagagagaaatccccaaaccttcccgtaaattttttccatatagtagtaaagaccaccagttttaggcatttgggaggcaatctcagcaatggtaaggccagcagtcaaggtgatgataccacctgcaagccaagctaacatggcatttgtggtggaacctgcatcatccaaaacggcggcctggcggacaaacacgccagaaccaatgatcgttccgataacaagtgcgagtgcggaccaaaggccgagtgaccggttaagggttacttcgtctttttcattgttcattaagaaaacctccttaaaatttaatttaagtaatattgtaacttaaatgtgaattagtcacaagttggtagaccgctgcgttcaagcttactgcaggtcacaaaaacaatgcgcccgtgaagctgattagtacgccgaaatgagtatattttcatattaacataaaaatatgaataaatattcagatattagttgaaatatccaaaaaacgtgtatataataaatcctgttaataaaaacaggggagttaaaacgtatgaaaaaacaaaataatttaaaaatttcggcaattggggttttaatcgcactcacattagcgggttgtggaagtaaaaaggccagtcaaacagaagttgtgaatatgtcaacggggacggaaatcacaacgcttgattcgtcaaaagcgattgatgacacgagtttaacccaaatttccaattttaatgagggactataccggataggaaacaaaagtaagattttaccagggatcgcgaaacaggtaacggaatcgaagaatggaaaaaaatatatatttactctgagaaaagatgcaaagtggagtaatggtgataaagttacggcgcaagactttgtgtatgcttggcagcgaacagtaaatccgaagacggcatctgagtttgcttacctgtactcaggaattcataacgccgataaaatttcggcagagaaagcgtcagttaaaacgctaggcatcaaagccactggcaagtacaaattgactgttactttagatacaccgattccgtattttaaactcttgatgggatttccaagtttcttcccacaaaatcaaaaagtggttgaaaagtatggtagtaaatacggatcaagttccaaggatatggtttacgacggaccatttatacaaaaagggtggacaggtagtaatttgagttggaagatgattaaaaatcctaattactgggataagaccagtgtcaaactcacgcaaatgaattttcaggtaattaaagatacaactacaggcctgaatttgtataacagcaagaagttggatgaaacaacgttgtctggaagtcaagttgcccaatataagaacaacaaaaactttgtgagtcgtaaattagcacagacatcatacattgaatttaaccaaagcaaaaatacagttttgaagaataagaaaattcgtcaagcactatctttggcgattgaccgagatcaacttactggaaaggtgcttgctgatggctctgtctccgcaacaggttttgtttcaagcggtttgatgactgacctcaacaacggaaaagattttgctgcagaagcttccgtaccttcaggtgtttcatataatctgcagaaagctaaaaaactcatggcagagggtctgaaggaagaaaacaaaaagactttaactttagacttactgaataatgatagtgacgtgggtaaaaaagcatctgagtttttacaatctgactgggaaaaattgccgggggttaaaatcactttgacgaatatcccgtacaagtcatttttaactgatgaagccaacaagaagtttgatctagctctgtcaggttgggcggctgacttttccgatccaatttcatttctccaaattctaacttctgataatgcgcagaataatgggagctggaagaatgtagcttttgataaggcaattgaaaaagctgatactaccgatgccactaatcctgagaaacgatttaaggatatgattcaagctgagaaaattttgatgcaggatcaaggagtagccccgatctatcagagtacgcaagcacaactgtggaatcagaatgtgaagggtcttgtgcacaactcggcaggcatttactatgattataagaacctcaatgtcacgaagtaataaaaaatcgttagctatttagtttggtattcgcggtatttttaccaaattcaaagttaacgatttttatttgtctaaaggttgaaaccacaaaaacttatcttgttgctgcgcattattaaagcagcaaacgtttttaatccggaggtgattggtctcaagggggaaattatccttagtaattcattacttaggataaggccgagtttaaagacaagtgttcctcttggcttcaaatcgtgcccactattacacataagggttagttttcgtgccgaaaacttcaatgtttcatacgatgtcgattcttgtggcaaaaatcagccgcaagaactcgcaccccgttccagaccaagtgagccgcaggacggcaattaaactactgcttttgaaccaagtcgtttaatactagttattgaagtgattttgatacattcaaactttagttacttgttcaaaaaaacaactaccacagttttctgcagtagttgtattagaacttattcttcgacttcggccaccaaataatcatggaaacgttggtaatcctcactgcttaactccgcagtaatttcggtcccctcagccttgtagtctgtttttaaaacgttagtgtgctgattaagataatccacaacttgtcctctatcaaatggaattagaaaggtggcttcacgataaccagtaaagactttttgtttaatcatgttggttaacatcactagcgatcgtttatcctttgcagaataagtaatttcttcattaccttctagggttggaaaatctacgcccgccatgtcggctttgttgaatgccacaatcattggtgcctttgtcacaccaatttcttgcaaagtatcgttcgtggtctgaatcatctctctgaaatggggatcagaaacgtcaaccacttggaccaaaagatctgcttgagctgcttctgccaaagtggaacggaatgctttaatcaattgatgaggaagatgactcacaaatccaactgtgtcactaagtaaaagttgtttttgatctggaaaagtaagttttcggacacttgtatccaaagttgcaaagagcatattcttttcgaaaacttgtttctcatcactttcaccatacatccgaactaacccattcatggtggtggacttaccagcatttgtgtaaccaactaaagcgacgctgggtaaaccagtttgatctcgtttttgccgttgaacagcggacgaagttgtcatttctttcaactcgtgatttaaattgttaatccgttgctgaatggttcgccggttcatttcgagttttgtttcaccagcaccacggttggtataaccaccaccagcatcacccgccgattgttgatcaagcctttgtgacgaactagttcgtaatcttggcatctgataattgagtttggcaatttctacttggagttttgcttcgcgtgattttgcacggttagcgaagatttccaaaattaaaccagtacggtcaattacagaaagcttagattcttgttccaaattacgaatttggctgggagaaagttccgcatttacgaccaatgtttgtacatcaatgctggtacctaattcatgaagttcaacgactttcccactaccaaaataggtagctggattgggacggtctaatttttgaatgactttttcggttgcttccatattgtttgcttcaaccaaagctgctaattcctgcatggcataatccaagtcttgattaggcagctctaggccggcgataataactttttcggtcataactaacacctcgaattctttaataccccaagtatagcatagccgccggggtttataagggaatacgtcctattctacccgttaataagtttctctataatgtgtaaagaatgagagagcccttttttacgaaaactgggttgccagcaatttgacgagaaaaaatagagacacgttaatattattaaaaataaattagtaaattctattgtatttaatattcgtttaacctataatgaggtcggcttttgagaagaagtacatatgtacatatatataaataaaaggggtaataggttatgaaagtaaaatcggctgttaagctaggagcagttgcgttagcttcgacttttgtattagctgcctgtggatctaaaacaagtagtgccaagaaatcaacagtaaactttatggaatcatctgaaattccaactatggatacatcgaaagttactgatgttgttgggatgacacaattgtccaactctgaagagggaatttatcgtctgggtaaaaacagttctgtacataatgctttagcaacgagcacgaaagaatctaaagacggtaaaacttggacatttacacttcgtaaaaatgcaaagtggagtaatggcgacaaagttaccgctcaagattttgtttattcatggcagcgaacagttaatccaaagactgcttctgaatatgcatacttgttctcaggaattaagaatgctgataagatttcagcaggaaaggctaattacaagaccttaggaattaaagctgatggtaagtacaagttgacggttactttggatcgaccaattccatactttaagttattaatgggcttttgtattttcttcccacaagatcaaaaagttgttgaaaagtacggttctaaatacggaactgcttctaacaagttagtttatgatggtccatacaaacaagttggttggactggaacaaacttgaaatggaaacttgttaaaaacccgcagtactggaataagaagaacgttaagatggacaccatcaattatcaagttgtgaaggattcctccactgcattaaacctttacaatagtaagaaacttgatgtgacaactatcactggtagccaagttgctcagtataagaacaacaagaattacgttcttcgtaaggaagcttccacattctatctccagttgaaccaaaagaaagacaagttctttaagaacaaaaagattcgccaggctgtttcaatgtcaattgatcgtaatcagttaacatctaaagttttggcagatggttcgcaaaatcctttaggttatgtttcaactgatttagctaagaatcctaagactggtcaagactttgccaaagaggccgaagttaaatcagcggttacgcagaacttgactgaagctaagaagttattaaaggaaggcttgaaagaagagggtatgtctagtcttaagtttactttgatggctgatgatacacctgctggtaagacaaccaacgagttcttgcagtcacaaatcgaaaaattgggtagcaatgttaaggttaccgttcaaaacattccatttaagactcgtttaacagattctagcaatggtaagtttgatgccgttgttactggttggggcgctgatttctctgatccaatttcattcttacaattatttgtaacaggcaacgctcaaaacaacggcgactggagcaataaagagtacgacaagttgatcaaggcttctaacaccactgatgccacaaatcctacaaaacgttggagtgatatggttaaagctgaaaagatcttgatgaacgatcaagcaattgtcccaatttatcaacaagcaacgtcacaattgtggagcagcaaagttaagggtgttatttacaacactgctggtaacaactttgattactcgaaactttatgtaaaataggttaataaaaaaataatttttaaggttattgaaactgtaaaaggttttgataaccttttttagtggaaaatcttgttaattttcaactttgatttttcgaaaatataaccggtaaattagtttaatatagattaaacgaagatgagtgaattgcctaacccggttgaacttatgaaactgtttaactatgaaaataagatattaatcaactagaaaaaattttcataagaaaatatgaaccgcttcattagtaattgagtgtgacgtagagtaggttcaggaacagtaatagttgctattatttgtgaattaaaaatcaattaaataaaattagagattcttagttgcgtttaatcttgttttaatgtacaatgataacaacttttgagaacgaaagtaaaaatgatgttaagtagttaattggaaaaggagtgttagtgtatgcaaatcaaatccgcagttaagcttggcgcggttgcgttagcttcaacttttgtattagccgcttgtggatctaaaacaagcgatagtgcaaagaaacaatctgtaaactttatggtggcatctgaaattcctactatggatacctctaaagtaaccgacacaattggtttaactcagttagccaatactgaagaaggactttatcgtttaggtaaaaacagttccgttcacaatgcattagcaacaaagacagttgtttccaaagataaaaagacttacacatttacattacgcaagaatgctaaatggagtaatggggataaagttaccgctaaagatttcgtttattcttggcaacgtactgtaaatcctaagactgcttccgagtatgcttatttgttctctggcatcaagaatgctgacaagattgcagcaggtaaagctaattacaagacattggggatcaaagccgatggcgattacaaattaacggttacccttgatcgtccagtaccttactttaagttattgatgggatttgcactctttttcccacaaaaccaaaaagctgttgaaaaatatggttcaaaatacgggacagcttcaaacaagctggtttataacggaccatacaagtctgttggttggaccggaactaacttgaaatggaagttagtgaaaaaccctcagtactggaacaagaagaacatcaagatggacactattaattatcaagtagttaaagattcatcaactgctttgaacttatataatagtaagaaacttgacgtaacaacgattactggtagccaagttgcccaatacaaaaacaacaaagcttacaagttacgtaaagaagcttcaacattctacctccaattgaatgaaaaacggagctactttaagaacaagaagattcgtcaagctgtttcaatgtcaattgaccgtaatcagttaacatctaaagtgctagctgatgggtcacaaaatcctttgggttacgtttcagctggattagctgagaaccctaagacaggtcaagattttgctaaagaagcacaagttaaatcggctgttacccaaaacctcactcaagctaagaagttattaaaggaaggtttgaaagaagaggggatgtctagccttaagtttactttaatggctgatgatacacctgctgggaaagcaaccaacgaattcttacaatcacaaatcgaaaaattgggtagcaacgtcaaagttactgttcaaaacattccattcaagacgcgtttgacaaactcgacaaatggtaaattcgatgctgtagttactggttggggtgctgacttcgctgatccaatttccttcttgcaactctttgttactggaaattcaaacaataacggaagttggagtaacaaggaatacgataagttgatcaaggcttcaagcacaactgatgccaacaacgaagaaaagcgttgggacgatatggttaaagctgaaaagatcttgatgcaagaacaaggtatcgtaccaatttatcaacaggctgcttcacaattgtggaacacgaagttgaagggtgaagtttacaatagtgctggtattaacttcgattactctggtcttaatcttacagaatagttcaaattaacaacttaattaaaaaactgaggggaagggcgtgcttttagtcgctcttctccttaatttttcctagatgtgatctctctaagaattgtgtgggtaaaattgccgaaagtttcaactttataagaaatttcatgaggtgaaaatgagcaattttaaaaatgtaacaaaaagcgcatacattcaaagataacaagctttcatgatggacaattattggcaaaaaggtccgttattcttaatataattagaacaagcaattgaatttaatcttcttctaatatataatgagaacaacttttgttaagaaagtacatacaatgaagtcagttaagatttcacaaaggggttggaaaaattatgaatgtcagatcagctgtgaaggttggggcggtcgcgctagcttcaacattcgtactagctgcgtgtggatccaagaatagtagttcgtcaaaaaaatcagttaactttgaagaaagtgctgaaattgctactatggatcagtcgaaggttacagatgttgttgggtttactcagttaggcaatacgcaagaaggactttaccgattaggtgctaaaagtaaagtcaacaatgcacttgctacgagtacgaaagaatcaaaggatggcaagacttggacctttacaattcgtaaagatgctaagtggagcaatggcgatcctgtaactgccaaaggttttgtttatgcttggcaacggacagtcaatccaaagacagcttccgaatatgcttacttattctcaggaatcaaaaatgccgacaagattgctgctggtaaagcaagctataagacattgggcattaaagcagatggcaactacaagctggttgttagcttagatcgcccaatcccttacttcaagttgttgatgggcttcccaacattctatccacaggaccaaaaagttgttgaaaagtatggttctaagtacggaacatcatctgataagctcgtctacgatggtccatacaagcaaactggttggacaggaactaacttgagttggaaacttgttaaaaacaacaattactgggataaaaaagatgtcaagatggataccatcaattaccaagttgtaaaagatgccagcactggtttgaatctttacaatagtaaaaaacttgacgttgcaaacatcactggtaaccaagttgcccaatacaagaacaacaaagattacgttttgcgtaagcaatcctcaatgttctatcttcaatacaatatgaagaaagaaaaagtattccgtaatgctaagatccgaaaagctatttccatgacaatcaaccgtaaacagttgactagcaaagttttagctgatggttctggtaatcctaaaggccttgtttcaactggtttagcaagtaatcctaagactggcgaagatttcgcttctgaagcagaagtcaaatcagcagttaaccaaaacctgacagaagctaagaaattaatggctgaaggacttaaagaagagggcaagtcaagcttgtcatttacacttcttggtgatgatacagcttctactaagcaaatcactgaatacctccagtcacaaattgaaaaattaccaaatgtgaaagttagtcttcaaaacgtgccattcaagacccgtttgacaaactcatcagatggtaagtttgatgttgttctttctgcttggggtgctgatttctctgatccaatttccttcttacagttatttgttaccggaaacgctcaaaacaacggtggtttcagcaacaaacaatatgataagttgatcaaggcttcaaatactaccgattctactaatcctgagaagcgttgggatgacatggttaaggcagaaaagattttgatgaacgaacaaggaattgcaccagtcttccagcaagcacaatcacagctttggagttctaagttaaaaggtgttgtctataacagtgccggtgttaactttgactacaagaatttgaatctgacaaaataatgcggcataaaattaagcgttaattttggacgaagggtaagggttcgcgtaactgctgactcttacccctttgttataaaggcaatgttggtttgagataggaaaagatagggaggaatataaatggcaagatatttagcaagacgaatcttttatctggctttaacgctgtttttgattgcaagtatcaccttcttcttaatgaagctgatgcccggaacaccgttgaataaccaggcaaaactaacaccacaacaaatcaaagtgatttatgagcattacggtttgaataagccggtttggcagcaatatgtaagttatatcctagatgctgctcacggtaacttcggattatcattccaatttagtgatcaacctgtatcttatttgatctcaagccgaattggaccatccatgcagttaggtggtcaagcaatggtagttggtgtcgttgtcggaatcgtggttggctcattgagtgccatccgtaaaaacacatggattgatggaacttcaacatttatttctattttaggaatttcaatcccaagtttcgtgttagctattttacttcagtactatttaggactgaagttacagcttttcccaattgctgattggggcggtttctcatacacggtgttaccaacgttagcccttgcggcttcaccatttgctgaaacttcacgatttgttcgaacagaaatggtcgatgttttggggagcgactatattgaacttgctcgtgcaaaaggtctcagtcgaatgggaattgtttggcaccatgcgttacgaaacagtttaattccattggttacagttatcggtcctttgacagctgctatcatgactggttccatggttgttgaaaacatcttctctgtacctggtattggtgaacagtttgttaagtctatcttggttaatgattatccaaccatcatgggtgtgacattgctctattcagcattgctatgtgcgatcttgcttttaactgatttggtttatggaattattgatccacgaatccgaattactgggaaaggggaataaataaatggaagaaaaaatgaacttagcaccggacgcatttgagccggtttccaaaaaagatgaactagatgatgaaaaaattgttgccccttctcggacttttattcaggatgcttggcggcgtcttcgtcaaaataaggcttcttacgtttgtttatggatccttgttgtaattgggttaattgcctttacttcaccgattacagcttcacacccaaatgtgtctcatccaaactacgctaatttaccacctaagattcctggtgtgaatattaacggtttgaacggaacgacaatggttgccggtaagcgagttgatgcctacaaacaaaataatgtgccaagtaaaattcattatactttgggaactgactacttaggtcgttctcttgcagaacgtattttacgagggactttggtttcattattaatcggtttatttgctaccctaattgatttgattgtgggtgttgggtacggggttgtctcggcctggaaaggtgggataacggatattatcctgcaacggattattgaagttatttcatctgtaccaaatattgttatcatggtcttgttaatgcttgttttaaagggtggtatgttaccaattattttggcaatcgcctttaatgggtggaccacaatggcccgactcacacgtgcacaaacgctacagttaaagtcacaagagtatgtgttagcggcacgaacgctaggtgaatcaacctttaaaattgcggtcaaacatttattgcccaacctttcaagtgtcattattattcaaacaatgttcaccattccatcagctattttcttcgaagctttcctaagttatattgggattggtattcaggctccaactgcttcgctaggaacgttgattagtgatggtcaaaagaacttccagttcttaccatatcaaatgtggtaccccgcgattatgctttcaattattatgattgcgtttaatattctcgccgatggtttgcgtgatgcgtttgaccctcggacagctcgtagataggaggaagatacaatggaaaatgcagatgaaaatattctggaagtaaaagacttaaccattgacttccatacctatgcaggtacggttaaggcgattcgtgacgtttctttccatttgaaaaaaggagagactttagcgatcgttggcgagtctggttctggtaaaacagttaccaccaaaacagttatgggattactagccaacaatgctgaagtggttgaaggtactgtgaagtttcgtgggaaagacattttaaaaatgtcccaaaaagaattggaagatattcgtgggaaagatattgcggaaattttccaggaccccatgacttcattggatcccacaatgagaatcggtaaacagattgccgaaccattacgtattcataaaggctatagtcgtgaaaaagctaacaaacaagctcttgaaatgcttaagttagttgggatcactaatgctgaagaacgaattaatgattatccgcatcaattttcaggtggtatgcgtcagcgaatcgtgattgcgattgcgcttgtctgttacccagaaattctgattgctgatgaacctactactgctttggatgtgacgattcaggctcaaatcttggatttaatgaaggaattgcaggaaaaaatttcgacttcaattatctttattacccatgatttaggggttgttgccggtatggctgatcgtgtagctgttatgtatgctggaaaaattgtggaatatgggacggttgatgaaatcttctataatccccaacatccatatacatggggcctactaaactcaatgcctaccttggatactgccaaaggaaaactggaatctattccaggaacacctccagatttgttggatccaccagcaggtgacccatttgctgctcgtaatccttatgctatgaaaattgatgaagaaaaagaaccaccatttttcaaagtttcggatacgcattatgcagcaacttggctcttgcatccagatgcaccacatgttgagcctccagtagaaattaaacgtcgtcaagaggtttacaaggagcgattacaggaaggtacgatcaaccaaggtcatattcattccacaggtaatacaacttttggaaccgatgatgatgacgcaattggcgagtaaaggaggctaatcatggatacacgagaaaaaattctagaagtaaaacatttaaagcaatactttaatgttggaaaaaaagatgaagtacgtgccgttgatgatgtttcctttgatatctacaaaggtgaaactttcgggttggttggtgaatctggttcaggtaaaaccactactggtcgtgccattatccgtttgttggatcctactgatggtcaggtcttatttaatggtcgtgatgtggcttcattgaagagtaaatctgatatgatggcctttcgtcgtgaaatgcaaatgattttccaagatccatatgcttccttaaatcctcgtatgaaggttaaggatattgtggcagaaggaattgatattcatcatttagctaaaaatgataaagaccgaactaaccaggtagaagatttgcttgaaactgttggtttgaaccgggatcactctagtcgttatccaaatgagttttctggtggtcagcgtcaacggatcggaattgcccgagcgttagcggttcaacctgatttcatcattgctgatgaaccaatctctgctttggatgtttccattcaggctcaggttgttaacttgatgaaggaattgcaagaacaaaaagggttaacttacttgttcattgcacatgatttatcaatggttaaatatatcagtgatcgaattggtgttatgcattatggtaaattacttgaaattggacctgctgaagaagtctataacaatccacttcatctttacacggagagtttggtttcggctgttcctcagccagatcctgagtttgaacgtaatcgccgtcaggttgtttacgattcaacaccagagtttgatggtaagaagcgccaaatggtagaaatcacccctgaacattttgttcgtgctagtgaagatgagttagatacttatcgcaaacgagcaacagatgcagggttgaaaccacttatctaaatacaaatacgaggtcaggcaaaaacataatttttgcctgacctcgttttttttaccatattttgattttaaaaagttcttttagaccagacagcactagggtcgggatcgcgggtaagaaaatcaccgcgatgtagatttgccagttaagcatactggtccccataaatgtgttgaaaaatggaagcatcgtaattgccagtgaggagattcctgcaaacaatacagcggccaataaataggggttactgaatggatttcggcggaataatgtgtgggtacttcgagcgtcaaacacatgccataattgaccaaaaactagggttaagaatgccacggtttgtgcttcattgacctgcatgccagatttagcggcccaatagaaggcaataaaaacggacaaccccattaccacgccgcgaatcatcactcttgataacaggtgattagccaacagggattcatggacattacgtggttttacagccatgacatcgtgttcagcatcatcgtaacccagtgcaaatgatggcagggaatcactgatcatattaacccacagcaccatgattgcagttagagtgggagttaattcggaaatgtggccaattgaatgggttatgaaaaacgtgcccaacaaaattgacaggacttccgcaacgttagtagtgagttcctgacgcatgaaatttttaatgtttgcaaaaatggtccgcccagcagcgactgagttttcaattgtggtaaattgatcatccagtaaaatgagatcagcggagtctttagtgacttcggtaccgttgattcccatcgcaatgccaatgtctgcagcacgtaaggctggtgcatcattcacgccatcaccagtcatagcgacaacttgatcgtgtttttgcagagcattaataattcgttgtttatgttctggtgaaacgcgcgcataaacccgaatgtttgggaccacttcaaatagttgctcatcagacattttttctaattcttgcccttcaatgacgcgagcttgtttgtccttgataataccaagacgataggcaatagcgcgagcagttgctggatgatcgccggtaatcataacaacttcaacagaggctttatgcaaggtcgcaattgattttcgaacttctggtcgtggaggatcaataatacctgcaatcccaaggaaggtgagttgatcttccagttccgtttgtgtggcattaagggcttcttctttggttaaagtcctaccagccacagcaatggtgcgcagcgcatcattcgcatagtttaaaacctggtcttctaaggttgcttgagcttccttgattggaacagatttgctgtccaaaatgacgtcggttgtgtgttgcataatgacatcgggagcacctttagtaaataatttatagttattaccaattttaacgactgtgctcatcattttacgttcactttcaaacgggaaaacacgcagaatatcataatcttgatcgcctgtttgactgagcagattggcacgtgaaattttagctttatgacccagaaccactaaggaaacatcggttgggttgcctaatggctcgtagtgacctttctcattgcgttggatttgagattcattatccaaaatcgcacctttgataaaaggaatataatctgattcttggcctatttcaccatcttcaatcgaggtgatttcaccaactggatcataaccattaccatccaccgcgaaattaatcccatttgcaaaaaaacgggtaactgtcatttcattttttgtgagggtaccggttttatcagaagctataagggttgtggctcctaaggtttcaacactactaagggactttattaaaccccgattacgagctagcacccgtgcaccgattgttaaaacaacagaaaggacgaccggcatggaatccgggatagctgcaacggctaacgcgatggccccagaaacactatccatcaaagctgtaataggaattgtaccggtattaaggtattcttttactaaatcataggtgatcgcaatcaccacaaccccaattgcggcaaccattaaacgcttggtcaactgagtaatattttgttcgatcggcgttttttgtgttttgttttgttggagcagatcggcaatttttccgagttctgtgtgggtaccggttgcggttacgacacccagaccacttccgttaacaacggttgatcccgaaaagcccatgttagttcggtcggcgaggtcggtatttttaggaaggactttggagtctttttcaacggcatcagattcaccagttaaatgagattcattaacttgaagttcattcactgaaagccaccggagatcagcttcgatgaagtctcccattttaacatcgacaatgtcaccggggacaagttggcttgcgtcaattttttgccagctttggtcgcgtaagacgtttgcttgatgttgggaagccgaacttaaagcgtctaatgattttttcgcacttaacttttgccagtaagttagaccagaattgatcaaaatgacaatcaaaatcacaattccttcataaactgaggaaagtgcatgggcaggatcgttcttcgcaaaaaaatcatagcttgcactgattaaagtcagtccaattgcgatccaaagaatgatgatgatcggttctgttaaagactgtaaataaacttttaaagcggactcatgtttttcttgctgtattttgttggggccatatttagttaatctggcctctaccgattcagttgtcaaaccatcatgacgtgaagtttcaagctgtttgacaacatctttgcgtttctgtgaatacatgggtacatgcctccttgggtaatgtgtctgcgtgcagttctgtaacgaaatggttatcctgttgccattattccaggaaaaagaacggttcgtcaactgaaacgggttagcaaaaacaagagttaaaaaagcgcattagattttgaacatgctatgctcagaatctaatgcgttttttgctattcttgcttatttttaaacgctactcttacggataattagtgaagtgccaatggtcactttacgtggtaccatatcacgtttttgaaattgttcatttaaaaggttaaacgcggcttttgccatgccatatcgagaaatatgaaccgtacttaaacttggatttacgtatttggcagatgtaatatcattaaagccaataattgatacttgctctggaattgtaattctttgttcagatagagctcgcattgcgccaattgcaatcgcatctgagccgattaaaaaggccttaggtaactttgaacctagagtatggataatttcttgcattgcttgatagccggactcagccgtgtattcttcggcgataaagaagtagtccggattaaagacttcttcacattctaggaaactctttgctaagaaccgttggggatcattttcataggtgatcaaatgatgatgggaacgtttggccaccaaaataccgatttcactaattcccttatctaataggtgattagtggttctggctacggaagaggtgaaatcggtaacgacacagtccaaattatctaagagggtgtcagtgcttacaaacacaattggtttttgtaagccttttaaaatctgaatggttttcttaccaaaaaagccaactgcaatgatgccaatataggattgagcttcaagtttcttagcgtcatagtcaccttggaaaaaatgtttaaaacgataattactgtccgttaagcgattatcaattgcaatgcgtaatgacatgaagtaagcatcatacaattcttcggattctttataggaaagtacgactgcaatagttccgttggttttgtgttttgttttgtatttgtcgtaagaaagctgttcggctgcttcaaaaatatttttttgagtactttggctcactgaaagggtctggtcaccatttaaaactcgtgaaacagttgatttggaaacgccagctaacttggcaatatcattaatcgttgcgataaaatcacctcatttttataaccatttaagtatatgagaatctttaggctttcgcaagtgattttttgcaagggcttacaaagctaaaaatgtgtgtaaaatataaattgtaaaaataaaaaagtttactaaactaattaggagatgtgcttagaatgaaattattattaatgagtcacggcaatatggcgattgaaacgttaagaagtgcggagatgattttgggaccaattagtggtgcggcagcaattggattgcagcctaatcaaggcccagaagatttacaagcagctgccgaaaaaattattgcagataatccaaatcaagaaccggttgtggttattgttgatctgttaggtggaaccccttctaacgtggttgttcgtttaattgccgctcatccagatttacaagtggttagtggtttaaacttgccaatggttattaactatgccaaccaaatgatgatgggggacggctttgacaaatcagtgatgatgaacgaggctaaagccggtgtgatcgacgttaacgctaaattaaatgaataatgaggacatgaaatgacagcaaattttaagtattcacttcgttttacgcttgatcccgaaagttgggatgctaaaaaagaagcaaagttgctggatttctgtaagaaaggtcgcattgatgatgtggccttttttataaatccagaggaattaaatcaaagccatttagatgaaaaacagaatcgggtttggctcaaaaccattcaatccgtaagtttaagcctaaaaaagttggggatcacaaccagtctgaatccatggaccacactgatgcatagcgatcggggccgcaagataaatccgaaacttggtttcagcacaatggttgattatcaaggaaaaaaagctgaatccattgcttgtcctggcgaccccatttggcagaactatattgccgattgttatcgccagtttgcaagtatccagccaaatacgctttgggtagaagatgattttcgccattataaccacacacccttaaaattgggctgtttttgcgatcgtcacatgcagatttataatcaaaagcttggcaaaaatttaagtcgacaagagtttatcaaacttgttttgcagacaggaaaaccaacccaagaaagattggtttatttggagactgcccaacaagaaatgatccaggttgccaaaaagattgcggaggcagttcgacgcgtttcaccacggactaaaattgggttaatgagctcttttcccaactggcatgctatagaggaccgtgattggtctggcctttttgacgcgttcagtggtgagcatccgcgtgtaaatcgtccccatttgccggcctataacgaagtatcaccattgaaatacagtcgcgactttgaagcatttaccagaaccacagctgcctttgtttctaatggtccacaaagcgaattttatccagaattggaaaattatatgtattcaccatttgctaaatccaatctgttcacgcaatttcagctggaaagcacggttttaattggcgcatcgggaatctttttgaatctatttgacatgatgggaaatggaattgatgaaagttatcactatgcacagatgttggctgattctaaaacgtggttaaatcatgtcagtgattcaaagacaagattaaatcgggcgcagttcagtggtgtcatggtgctgatggatcaaaattctgcgcaaacaatccatacgagtcagggaaaagatcctgaagaattgttacccaatgagaccaactggctatccttattcggtagtttagggattgccagttttcctcaagcagatacacgtaaaacccagtatcatgatcaaactgtcgcaataagtggtcaatttttacgaaatttaaataatgcgcaaattagccaattagtaaaaaacaatacggtgtttttggatggcgaatgtgtgcaggttcttcttgaccgcaaattggcgaaaacattattgagtgtaaataaagcagagtggcatcaggctcgaacaggctatcagtcgtttgaacaggctgatggacaaacagttgatggcattgaaaatccccgaattaccatgttacagcatactggtgattacttacagctagcgtataccgaggatgctcaacttgacgttatctcaaatgcttacaatgaatatcataagcacctcggtccgatgatgaccgtggtcaatgagcgtacttttatcttgcctatgaatacggatcccaagtacggctgggagtcccagtattattcaattaaggaaggcttattcaaacactttttggagaaacacacccaagttagttttgctgttgaaatgccaggagtcaaattggtcatagaacaaaaagatggatttaaagcttatctttcaaacttcacaattgatgatcagtccaaaataaagctacatttagcagaacaataccaatttacacactggattttgcatgcaaaaaatggttcagatctaaaggatgtttcgattcactgctcatgggacaccaatgggattggtacgatcaattattctctaaaaggattagagaccattttactagaggcagaagtttagtaaaaaaataaaactttttattgacttttattgaaaacgctttattaatataggcggttggtaccagttgatgctattcaggtgcgcacctgaattgattgaatatttctgcaattattttatttttattaaagctatgggagtgatggataatggcaattacagcagtacgaattgacggtaggttaattcacggccaggtagcaaacctatggacaacaaaattaggtgtttctcggatcatggttattgatgacaaggttgctgccagtgacattgaaaaatctgggttgaaactggctcgtccaacaggaattgatttgagtgttttacctgaaaagacagccgctgaacatatcaaacgtggtggttacgattcacaaaaagtttttatcgtcgttaaacggcctcaaatcttattggatttggttaatgatggcgtcaagttagacacgatcaacgttggtaacatgtcacaaacagacgatacaacgcaattaacaaactcaattaatgtggtgcaatcagatgttgacgcatttaacgcgttacacgaaaaagaaatcaaagtaacttcacaaatggttcccggagataatgcgcaagactttatggaaattttgaaaaagtttaagccgaagaaataggggagggttcagttatgggcacgagtattgctttatggcaagtgattgtcttaacaatctattccatgtatcaaatcatggatgaattaacattgcagaccagtttgagtcaacctgtttgggccggtttaattgccggtttagtcatgggagatgtcaaaactggattgattattggtggtagtttgcagttaaccgttttgggagttggaacctttggtggcgcatcaaagatcgatgcaaactcaggtacagttatggcaactgccttcgcaattggtgctgggatggatccacaagttaccgttgcagctttaggtgttccggttgctagtttgatgattcaaaccgatactgtcgcacgttttgccaacaccttcttccagcaccgtgtggataagatgattgacacagaaaattacaaagggattgaacgaaattacctttatggctatcttccttggacattgtcccgtgggattccagtctttctagctttagcatttggtggtccattcgttcgaactgctgtttcgtacatgaatgctaacttagcttggttaagtaatggtcttgcaactgccggggctttgttaccagccgttggatttgcaattttacttcattacttaccagtaaagaagcatttcccttacttgattcttggctttattatcacagcattgttctccacagtgtatggaaatatcagtttgttgggaacaaccgttgccggaattgatacaaaattcacaacaacatttgctagtttaccaatgttagctatcgccttaattggatttgcgtttgccttacttgaatacaaacgaagtactgaaaaagggaacgttgttgaaagcgcgactaaagtaactgaaacacaagacacacaagaacaggatggtgaaattcatggagatgaaatctaaggaaacaccaaaagtaacttataaactaacgacgaaagattttcgtcaaattaatatgcgaagcttgtttcttaaccaagtaggctggaactacgagcggatgcaaggatctggttatctctacattttgatgcctcaactacgtaaaatgtatggtgaccatactcctgaattaaaaggcattatgaagatgcaaaaccaattctttaatactagtaacttctttaatacgattattcaaggaattgatttagccgttgaagagcgtgaagggtataaatcattagaaacagttgctggtctaaaagctggattaatgggtcctttcgctgcaattggtgattcactgtttgctgcattagttcccgcaattatgggagccattgctgctaatatggcaattcaaggaaatgcggttggggctgtcttatggatggcagttaactttgtgattatgtggttccggtggattcaactgaaatttgcttataaacaaggggtcaatttagttacctctatgcagggacaactcagtgctttgaccgacgcagcaacgctacttggagtctacgttgtgggtgctttggccgcaacgatggttaacacacaagttatttgggtcgctcacctaggtaaaatgacagttaacttccaaagccaaatcgatatgatcatgccaaaacttattccagctttgattgtcggtggtatttattggttattaggaagaaaacggatgacttcaacccgagcaatctttatcgttattatcgttgctgttgttctttcggcccttggtgtgcttggaaaagcagcatagttaatctaattgaatagatcgaacgtgttaaaaattattttggcactctgtcgttatcatattgtgcataattaaagatttctttgcgcaggttgttaataaaaatgaaagatctggtatgataaagtcacactcagatcttttataatgcacaggagaaaaataaatatgacaattaaatatgataagaaacaaccattatatgaacaactcatggataagctaaaaaccaaaattaaagaagactacaagccaagtgataaattaccttcagaacgtgaaattatgcgagattattcggttagtcggaatacagttcgacaggcgttaaatgaactggaaatcttggggtttatttttcggcaacatgggaaaggcacgtttgtagctaatacaattaacaatccagccactttaggtaatgaacatagtttcactaaacagatgaaagcattgggccggaaaccagaaactaaaattatggagtattcaattcggcaagctagcgattattttgccgacaaattgaagatttcagaaggtgatcgcattattaaactgaaacggttaaggtccgcagacggagttccagtgatgattgatcggacttatctaccatatgcaaaatttgcggggctttcagctgatgaactagaggtcaaacaccgttcattatatggtgtgtttgccaaagattttggggagatttttcacattgcagatgaatctttatctgcaggaagaatcagtgataaggatgccattgtcttaaaagtccctcaaggttcgccggggttgatgctcaaacgaactacctataatcagcaaaatgaaattatcgaatttacgttaagtagcacacgcagtgatcaatttgtttataacattcggtataagaacgccaatatttaatcgattggcatatggaaaaatgaaaggggattcaaaagatatgttttcaaaaaatgatgcagaactaaaggaattaggcgcgattattaccacgcgcgaaattcagcaacaacccgaactttggcatgaagcttgggcaaattatcaaaatgcaaaacaaaaagtttctgatttcttagcaactattactaagagcgttagcgaaccagttcgagtagtcttcgttggggccggctcatctgcttatgtaggtgatacgttagtgccataccttcaattaaatggagatcgttcacagctccgttttgaagccattgacacgaccaaggttgtatcaacaccatatgattatttagaatccgaaacgccaactttattagtttcgtttgcgcgcagtgggaacagtccagaaagcgtggcaaccgttgatttagcagaaaaactagtcaagaatctctggcagttgacgattacctgtgcccccgaaggaaaattggcacaacacgctgaaaatgatgccaataatttggtgttgttacagccagctcgttcaaatgataaagggtttgccatgacaggaagctttagttgcatgatgttaacctccttgtttgtctttgatgtgaaacacacagacagtcaaaaggccagttatgtcgatcaaatcgccaaaatgggctctgaggttatcgatcgtgaagctgaagttcaagctgttgtggatactgactttgaacgcatcatttacttgggctcaggcggtttaacagggttaactcgcgaagctcagttgaaagtcttggaattaacagctggtcaaaaagccaccatgtttgattcttcaatgggctttcggcatggcccaaaatcctttgtgaacgaaaaagccttggtttttgacttcattagtaatgacccatatacacgtcaatacgatgtggatatcttgaatgaagttcaaggtgacaaaattgcccccgttgtctttggcattggcgtttctagtaagcttaattatgaaggccaaggattcacctttgaaaacggaaacgatcaagtgcctgatggctacatggcctttccagacattatgtttgctcaaactttggcgttaatgacttccgttaaggttggcaatacaccagacacaccatctgctacgggaacagtcaatcgtgtggttaaaggtgtgacaattcattcattagattagggggcaaaatcttgagttattatattcatgcagataagtttttcttagataatacaactgaaaatgggggttacctagaaatcactgatgatggcaagtttggtacttacacgagtgctaaaccaactggcaagattgtggattattctggctgttatgtgtcaccaggactggttgatactcatattcatggactcttaggtcatgacgtgatggacaatgactggaataaaatccaagaaatgtcggaaggcttgttgcaggcgggggtcacttcatggttgcccacaacattgactgcttcagctgatcaattagatgcagtttgcaagacaattggtgataattatcaggatgctaaaggtgccaagattcaagggatctactttgaagggccatttttcaccacggaacataagggtgcccaaaatccaaaatactttggtgatccgaatgtggagacgtttaaacggtggcaagaatcggctaaagggttgattaaaaagattgcaattgctcctgaacgtgatggggcagttgcatttaccaaggcagttagccaaatgggcgttagtgttgcgctcggccacagtgatgcgacgtttgaacaagcgcgggcatctgttgaagcaggggcaaccgtgtttacccatacatttaatgggatgagcgggttaagtcatcatgcgcctggtatggttggcgcagcaatgagcatgcataacacgtggcgttgattacagattgtatgcgtgctggtttgatttatgtcttgggagaatttcctgtgtatgtcgcagatggcatggcgcggttaaaggacggcgatagtttagcggggagtgtgcttcagttaaaacaagcggttcaaaacgtagttaactggaatgtttctacaccagagcaagctgttcagatggcaagtaaaactgctgcaattagtagcaaaatcggtaaccaatgtggtagtattcttcctgatcgggacgcggacttcttaatttggagccatgacatggacttgaaagaaacttatttggacggtaaatctcggtatcaagcttaaacaaaatgattgaattttagaaagcataaatcaaaatgcctttttggcagctttgattcatgcttttttagttgattaaattagttttgatgaccctgaattcgaatagcaaatgcatccaaaaagattctggtcaaaatttgtagtggcagtcgggaacgaatttcgtattttggaaagtaagattcggcagattttacgcctaaaaaaattaaatcagaatatggaattatatcacccgtgttgttacaggtgaaagtaattgtggttacttcgttgatagaaagtgattgtgcagccttaactaactcgggggtattaccatttaaggttaaaaatataacgacagtatccctaccgtttatttgtttgctcaatgttttgattatattgggatcatcgtgcaactgggcatctttaccaagtaattcaaactttaaaagaatgtcttccccaattaacttggatagagcacgagcaaaaatatagacatgtttggcattattgactttctggatggcatcttccatcacaccaatgttcagattggcaatagtattatcaacttcgtattgattctttaaaattgccgcccgaatttcatggtctgtttcctgtaaaattttaaaatcctgatttttgttagttaattttcgaatggcttcttggcgaaatggggtgtaacctgaataccccatttttttcatggttctgacaattgttgcagttgaaacattagctttttcgctgagttctactatagaagtgttcacgatttcgtcagcgtgttcttgcacatattgccataggtatttttccgatgtacttaatgtttcggtcacagcagtgcctccaaagttgtaaaagaattttcaagtttagattcatgatagcattttttgaaaacatttacatttcttgtgatgttattcttaaaacgaagataaagagaggagtgatgaaatgatttacacattgacactgaatccagccattgatttatttgttgatacgaaaacgatgcaacctaatgtcgttaatcggacagaaagttatgatattcaagcaaatggaaagggggtcaacgtttctttcattcttaaacgcttaggtattgaaaataaagcgttgggaattggcggtggctttacattaaactatattgaagaagttttggatcaagcagaaattgcaaatgattttgttcacgtaaaagatccaacacggattaatgtgtttacaagagttcaagatgaaaatcaggaatataaattagtcaataaaggaccaaagaccgatgccagtcagattgaacaattgttgactaaacttcgtcaactaaatcaaaacgatgttttatcgttgtctggtagtttttcagaaggcattaagcctgacattttagtagaaatcgcaaaaattgctgaaatcaaccatttcaaattggttttggataccagctatagcgaagtaatggatactttacgctatcatccttatttgattaaaccgaatgatcatgagttatcaagctggtttggacttgaccaagtacctggtcgagaaaagctaattgctatgggcgagacattgattaaaagaggagccagaaatgttttgatttctttaggatccgaaggggcgctgtttatcaacgataccgaagtcctttatggcaatgcagctaaaggcgaagtggttaacactgccggatcaggagatacaatgttaggtgcatttttaggtggtctaattgtgggtttagatggtcaggctaatttgaaacgcgcacttgcggctggtagcgatacagcctttcaatcttggataaccgattttaaaaatgtacccaacttggaagcacaaatccaaattcaattaattgaagaatgggggaaatagatcatgggaaaatataaaattattgcggccacaggttgtgcaaccggaattgcacatacttatatggctcaagaagcactagaacaagctgctaaaaaaattggcgtgacgattaaagtagaaactcatgggcaaaccggagttgacgatcccttaacgcaagcagaaattgatggtgcgagtggtgtaatcgtggcttcagatgtggacgtggacgctgatagatttattggaaaaaagttgattcgggtaccagttgctcagggaattcgtgaacctgataaattagtagatcgaattttaaatgatgcttcggttccagcatataaaagtggatccgttaaagaaaaagttgcttctagctcaactgggagcggcaaaaatggtgatacactttggaactcgatttatgtgtcattaatgaatggtgtctctcacatgttaccgttggttgtcgctggtggtgttctggttgcggtttcgtttttctggggaattaattcagccgatcccaaaagtgctgagtacaattactttgcatatctgttaaacaccatcggtagtaccaccatgaatctaatggtacccgtattatgtgcgtacatcgcggaagcaattagtaagcggtctgggctagttgtggggtttgcaaccgggatgattgcttttaatactggtacaggatttttaggtgccattgttggtggttatttagctggttatacaattatcttgttacagcatcttttgaaaccgctaccagataaacagtttcgtggattaaaagctatttttctttatccagttctaggtgtacttatttcagggatgatcatgtggtttatttcacttccaatgaaaggcttaaacactggtatgatgacattcttaaaaggaatggaaaatacaagtcctgtactgttaggactcattatcggtgtgatggccgcttctgatttcggcggaccaattaacaaagctgcttatttaactggaacggcattgttagcacaaggaaacttctacttcatggcaggggtttcggctgcctgtattgcaccgcctttggctacaggatttgctgtattgttcaaccctaaagcatattcaagcaatgaacgaagcgcaggatatgtaaactttctattaggatcaacgcatattactgaaggagcgattccatttgccgctaagaatccactgttaaatattccttcatttatggtgggatcttcaattgcagctattttgacctatgtaacgcgaatccaagtcccagctcctcatggtggtttcatcattttacctttagtcaatcatccgttcttgtgggttctttggattgtgattggttccttagtttccggtgtgctgttggcaatcattgcgggtcgccaagctaaaaaacatgctgttgcaaatgatgttgggacgattgatgtgttgacaggagaaacaacggaagctgagccagaacagccagtagcagatgccactccttcaaaaaccgccgaagatttcgatcctggggaaatcctgacgattgataatattcaattaaatgtgaaggcatcatcaagggatgaagttttgaagtatttagcagattttgccgttcaaaacaagttggctgacaatgccgacaaggtattagctaagtatttgaaacgtgagcaggaaggctcaacagggatgcaagatggaatcgcgattccacatgcacaggatgccacgatccattcttctaaaatgctgattatcaagttagcaagtccagtggattggaaaacttttgatgataaaccagttgatacaattatttcgtttttgattcctgaaaatgatagtggggcgcatcttaaatatctttctaacacggcaaaattattgatgcatagtgagtttgtgaaagaattgagatctgcagactctaaagaagaaattttgcgactcattaagcagtgatcgtaaaaatgtgaatgatttggctagtcttcgataaactttatcggagggctggcctttttgttttcccatatttgaatgatgcttttatttgacagtgttggttagcccttacataatgaatagtatagggataaatcggataaaggaggagtaggctatcatgtacaaacatttagtagcaattgtagaaattagggaaaagggctatacctatcattatgtatctaaggatgcccagaaggtaaacaaacaattctatctacttacccaaaagcttaatgacaatatgttagagatcttatatgaggcttctgtaatggaaactaatgatcagagcttagattctgtactaagttcagttggaaaaatgcacacaatccagttagttaaggatctacaggcgtttgtgaaactggtttatgataagaaacttattacaatcgccaaacggttgccagaacgcgaaatgaacaacacagagcagttattggactggtttaatggtgattaattaaggtagtttttttcatgttattgtcacaaattttcaaaggtataaagggtataaaatttatgagtcaaaaattatgagtggagggtcgttatggctaaatggatttggtatcatggtgattttgaaatttatcatgcaatgaaacagaactttgatcgcgaagagcgtggtatgaagtggccggcgtattggtacacctcgggatggaaccacaatgtttatttctgtaaagaagtttacctgaaacaacctgaaactttcacagtcaaagttcaaggggaaggttacggtaaatttgttgatttagaaagccacgaggaaacaaaattctcactgcttgaagtagtgacatgtccagtggggcattatcgtatcgaggtttatgtggcaaatctttctggcttaccttgtgcctatattgaaggaaaagcaattcagagtgatgagagttggcaggcttcgaattttttggatgatgccagcgctgttgggactagcaagtatttcgtaaaggctaatcaaaatccaatgcatttttcgtacacgcatgacatacgacacgcacaaaaggtagagtgtgttgagggaggactcttatttgactttggacatgatctgacagctaaaacggtgatcaggttcagccaggaatttaagccattaacattgagttatggtgaaagtcgtacagaagcgctggatgtaaaagatacatatttgaagcataagattaagtaaaataacgatccctttggggcttatgatgatgaaacaaaaacttacacaaccaaactccgcgcttttcgatatatttatttgccggatgttaaaaatactgaggatttcggtgaactgtccgttgattttgaattcattaaatttccctaaattgggcaattcacttcttcagattcaaaattaaccaagatttggcaggttgcagatcgcaccttacgcctatgctcaggaattttctttattgatggtattaaaagggatcgatgggtgtgggctggagatgcctttcaatgtttttatatgaatcgatatgatttttttgacaaagaaattgtagaacgcactattctaggcttgcgtggcgaactgaatattaaacagcatttggataccattgttgattattctatgtattggctaattgggatagagctttactacgaaacttttgcagataagcattttttgaaggccgtctatcccaaattaaagaagctcattgatttttccctagaggctaccgatgataatgggtttattcatgaacgtaaaggtgattggatctacattgattgggctgactttgatcaccaaggtccactatgtgcagagcagatggtattagcacgtgctttgcaaagtgtgattaaggtatctaaactgttaaataaagattcgcaaaaatatgagcgacattttcaaaaactcagaaaaaatatcgataagtattattgggatgatcaaaagcatgcttacgttgatagttatgagtctggcaaacaacgagtgagtcggcatgccaatatatttgcaattttgtttgattatgtggattcgcaaagaatggaaagcatatttaagcatgttttactaaacgacgaaattcctcaaataaatacaccttactttaaattttgggaacttgaagcttttgctaaagctggttattatcaaaaaagtgctagatgtgattaaaacctattggggtgggatgctagacaatggggcaactacgttttgggaatactttgatcctgctgaaaaaggtaatgaacgttttgcgatgtacggtgataaatatggaaaaagtctttgtcacgcatggggatcaagtccaatttatttaattgggcgttatttaattggtttaaaaccaactcaacctggctataaaacgttcgagatacaccctcaattggcgttactgggcaattttaagggaaagtttccaatcagtgcagaaggcgattatattgcattagaggtaaaagataggatgttgacgatagatgcgacaaaagcaggaggaacactcataattggtcataaacggatttcaattcctactgagcaccgagaaagcattgtaattgaaggcaacaagtaaaatcaaagctgtttcaaattctagtcaaaacacaaaaaaaccaatccttgggaggaaggattggttttcttttatttacacatcaattgtttagatctttaaaacttctcggagagcaaagaaggtaacgatgagctgaccaagggtaacccaaggattgtggtgtgcggctgatgcaattacagcagcgatgataacaactactgcccacagcattgtctttgtaatcttttcccttttttgtttatcgttcaattctggtctttcgttcattttattgacctcctttacaaagtcagagttttaaatttccgtactattacttagtctttatcagcagccaattccttagcatagatagcattacgtttcttcatttgacgagcgtaccaccagaatactaagcaatatgcagcaagtccaataaccgcgtaaagaataaatttgatttcaccagtagatgatttacctacagcgtaagctaagaattgttcgataggaccttccttagttgactcagcaatcattgtgccacttttaacaccggcagggaatgcaccaacttgttttgcaacagatgtaacaaatggagcactcaatgtaccagcccaaaggaagataggaatttcaacagtaccaataacgatcatacgaatgatacgtccacgagttacaaccaagagagctggtgtaacacccatagcaatgattccacctaaaggaaggatatggttgccaggaagaactaatgattcgagtaaaagaataggtgcaaggacgtttgcagctgcccacatttcggaacggccagcaataaatggccagtcaagaccaatgttcaacttacgaccctttaagtgtttggtagctaagtcagtaacaccttgtgataatggttcaacagctttgatgaaccatgaaccgataagtgagaataactgcaagcagacaccaccagtaaatgacaatgtaaagattgattcaataccttgttgtccaactaaaccaatgaaaatacctaaataacatccaatagcgaaattgcttccccagaatccaattttttcattcaattttgcggaatcaaaatcaaaacggtctaaccaacggaataataaatcataaatcttgttcaataccatgattacggggttcatcatataattcaaatgagtagttgtcattgggttatcatgattttccagtaaatcatcaaaagttggtttcatcaagtctgagttaacgatcttcaatgcaccaatcaagataataagtgctgtagctacccagaaattagctccgaagtaaattgccatcaaagctgtaaatgaaatgtgccaaatatcgaaaatatcaacatccaacgtgttggtccatttgaggagcaacataccgacgttcaatagaaccataattagcaagaagaatagggtgtatggagatccccaagtaatagttgctagaggtgcccaaccaacatcggtaatggaaagttggatacctgttgacttaacgaaagctgttaaggctggttgataagtagtagtaagaatattaataatagcactaataccagtcaaagcgatcgctaaacgaataccaccttcgagggctcggaagaatttaactcctaaggcccaggcaatcaaggttagaacaattaacataactggcgcagcacccaaatcaataattggtttgaacaccacgttggcaaaatggataatggtctgcattttgttcaactcctttgagttttttaaattttgttaccaatagtttaagaagacgcataaagaaaatatgtatgtgaagagagtaaactctcttcgaacgtattaacttaaatgattctttttgatagcgtcttcaattttatcgtacactggagcagccatagcaggcattctgtaaagaatagcaccagcatcaatttctggaactgtaatgtcgaaactcaagtctggtttattgataggaagaaagacttgaattcccttcatggtttcagggttgaggtccttgatctgaatggcttcaacgtgaacttggtaaccacgtttcttcatttcagcttcaacagcatccttaatttggtgacttgagttaacaccagcaccacaagcagttaacattttaatcatagtaaaattcctccttagaaatttttaaaattttattaccataaattaatgaagcaaacaactaaaacttggatttcaagaatgaataaattgcatcctcagaagtactcttgaaaaaggtcatcaactgattttgcggagtcttattaatgaaatccataatctgtgcgaggacatttgactgaccttctggatcgtcattcaaaatcatgaataagaagctaacttcaaattcttgacttggatcaatcatattgttaaaggcgatcggatgttttaacttaataggaacaactttacgttctttaacaaattcagattccgtatgtggaatggcaacgttagggtattctggtgaaaccactgacaagtcaattccagttggatacttatcttctcgttcgtttaggttcttcagaaagtcctcagtgacatgacctttcttgtaaagatcattggcaacttccttaaaaacatcagctcgtgaggttgcatcactcacatatactgtgtctctatcaaaaagagaagtttctgctatcttatctgacatatatattcaccacctcaatcacaaatgttaaataatgttaacttttgtttgaattcgtttacaaatctaattatatacaagcgcttccaaatgtcaacaaaaaatttaaagcaaaaaaatgttgcgtgcctattgacttttagcggaagcccgtctattctataaatcgaaacataaataaacaaaaacgaacattttttgttcttaaattatgtaaaggagggaggccagtgctgaaaaatgaacgagttgctaccattttgagcacggtcaatcaatcaggtgttgttaccatccaagaattagtgaacgatttgaaagtttcatccatgaccattagacgcgatttggatgaactagaacaagaacggagaattgttcgcattcatggtggcgcacagagtattcatttccctgataaacaagaagcttcctatatacagaaacgaaagctgaatgtgacagagaaaacggacatcgctaagcaagtagcaagtatgattgatgaaaatgaaaccgtttttttagggccgggaactaccaacgagcttgttgcgagttatttgaacttggcaaacttgagaattgtgacgaatagcttgccagtgtttgaacagtttagagataagcacagtgattacgaactatgccttgtcggtggaacataccgtgaacgaagtggtgcatttataggaagcctggctaacgagcttcttgcgaacatcaaaatgcataaagcatttgtgggtgtcaacggaattaatggtaacagtattatgaacgctaattctgatgaaggccaaacacagagcattgcgttagatcagtcacaacaaaaatttgtggtggcagatcattccaaactcgatcgcaatgatttctataccttttaccatttggataaagtggatggattaatcaccgatcagggtggtgaaaaacaagttctggataggtatcagaaaataacgcacgtctatacggacgcaaacacaaaacaaaaggagagatttgcatgaaagtcgtaattggctcagacaaaaaaggatttaatttaaaggaacaagttaagaaatacttgttagatcatagttatgaagttattgatgtcagtgaaaaacctgcagaagactttgtagaatcatcacttgccgttacaaaagaagttttgaacggtgatgctgataaggctgttatgtttgatgagtatggtgttggttcagcaatggcaagtaacaaggttaaaggaatggttactgctaatgttgttgaagaaaataccgcccatatgaccgctatgcataatggtgcaaaggcaattgcaattggtagtggtgttgttgctgaaaaattagcatataacattgttcagtactatttggacacagaatatgcaggtggccgtcaccaagttcgtttggatatgttggaaaaaatgatctagaaagtgcggttattgacttagagtgaacgaagcaacttttcggagtagcttcaatccagtctggaaaacacaataggcataaagagattagagaacgaaaacgagaaacaacatatcacagatagaatcgattcaagactaaatattaacttcaaggaggaattacgaatgattatttctattggtaatgaccatattgttacagatgtaaagattcaactttcaaactttttaaaagcacaaggacacacagtaattgatgaaggaacttatgatacaacccggacccactacccaatttacggcaaacgtgtggctgaagatgttgctgatggtcgtgctgacttaggtgttgtcctttgtggaactggtattggtatcagtactgctgcagacaaaaacgaaggtgttcgtgcagccttagtttcaaacttagttggtgctcgttacgcaaaagaagaattaaacgccaatgtcattggttttggtggcgcaacggttggtgaacatctttgcgaagatatcatctctgtattcttagattctgaatataaagaaacaccagaaaacaagaagttgattgacaaaatcaacaacattgcaactccaaacccagaacaaaaagacaacccacatttctttgatgaagagaatgaaaagtgggctgaaggagtttatcacgattagttgtgaaatcttgacaagcgttttataatgaaagcgttcttgaaataactcatgagaaatcatgaaaaacaaaaaaggggtaatcattttatgttgaaattaacaccaggtaaggaaaaaggaatcaaagctttatcaaataaagatggcgtcattgatgctttagctattgaccaacgtggatcattgaaaaaaatgattggtgctgctagtggcaaagaagcttcacaaaaagaaattgaagacttcaaagttgctgtatcaagcgaattaacaccatactcaacaggtatcttgttggatcctcaatacggacttccagcttcaaaagctcgtgcagacggtgctggcttattgcttgcatacgaacgcaccggttatgacgctactgagcctggccgtttcccagacattttggatgattggtcagttcgtcgtttgaaagaacaaggcgctgacgctatcaagttcttgctctactacgatccagacgaaggcggcgatattaaccatcgcaaacaagtctttatcgaacgtttaggtagcgaatgcaaaggcgaagatatgccattgttcttggaattagtatcatatgatgctaacaacgacgatgcaactggtaaagattacgctaaggtaaaaccaggtaaagtcattgcaatgacaaaagaattttcaaaacctcaatatggtgttgatgtattgaagcttgaagttcctgtaaaccaagcatacgttgaaggatttgctaagagctctgatgacgttgtttatacacgtgacgaagctttgaagtattacaaagaacaaagtgatgctacagacttaccatttatcttcttaagtgctggtgtttctgctgaattattccaagacgaattgaagtttgctaaagaagcaggctcaaaattcaacggtgtcctttgtggccgtgcaacctggcgtcattctgtagaaccatttgctggtgaaagtgaagcatctggccgtaaatggttacaatcacaaggccgtgaaaacattgaatcattgaacaaggttttgttctcaactgcaagttcatggtttgacaaggttcaaaaataattgattttactttaaataaactgaagtattatgtatagaaaattccactggattcctccacgggaactgggctggaacgcagtgggcacaatttttgagctaatgaattgtctcaaaacttggccttattgtaagtgttaaaacactaacaataatttcactgctaagcctaatccgttccggaatccagtggatttttcttgtttgatacagtgattttagtttgttttctaaaaatggagataatttatgagtagttttgatgagattaaaaaggccaatccagacaaaaccatctacgatatcaataatgatgaatttgctgattttggactagtttataaacaatatgatttgagtaaagtcacaaattacatggattctaaaatcgagattccaagtgatcataatgactatattcctgatgatgaaaacattgaaaatgatgctgccatcaagcaaattgcggctgatgtttatgcaggaatgcctatttctgcaggtccttgtgtgggccaaagtacttcattttctgccattgaatttcatcagggaagtgaagtcaacatcacgtttacagatgtggtgatggttttgggtaaacgccaagatattcatgattatgagtataatgctgaagagcatgccaaactattctttgtccctcgtggtactgtttttgaaatgtacagtgatacactgcattacagtccatgtaaagtggatgacggcggttttaaggcaattgtcatggttttacaaggcactaatcaacctttaccagatggctttaaagcaacgaataagatgattgttaaacaaaacaaatttcagatggcacatgccgttcgaaaagataaaattgcacagggaatcttacctggtgtcaaaggtaaattaatcgacattaagccaattcaaaaataaagaggtagatagaaatggctgacacagaaaagaaaacattatccacagaaaaaaagaacgatatcgatacagctgaagaattacaccaacaaatgatcaaagagcaattggctgaatttccggttactagagcttaatttagctgttacaaggtaaaggttgaagctacaaaaacttatcttattgcttgatacgaaaacgttcatggcagcaaaattagataaaatgccgtcttccagcaaatttgggctggaacgtagtgcgagttcttgcggccgaaaaacgaaaatcatcattactaggcggaatagtgcgagttcttgcggccgagcttgccacaagaatcgacatcgacaggagcaaaaaagattttcggaacgaaaatcatcattactaggcggaatagtgggcacgacttggtgccgcaagccacgtcaccaagctcggcctttatctaagcgaaacccgctaagataaacgacactactgagcccatttgctttcagactaagtctaatctttgcgatcaacacactgatataataattttgatactttcaacctttagatcctcaaaaaacacgtaaacttaaattgaaaaatggaaatgaatattaaagttgcacttcattgtgagatgtgtttgaatggactgcgaggtaattagttttgctttacgtaagctaatttcatgaaagtatgaaaacttgatatagtataacaagttcatttgtagtaaacttatttttgatttgcactgcccgagtttttgctcgggttaattttatttttgtagaggagcattataaaatgtggcgttatctaaaacggctcttgattggaaaaccgcttaagactttggacgagggtggacaatcattaacaaagtttagagccttagctttattgtcatcagatgctttgtcatctatcgcttacggaactgaacaaattctttccgttttgttggttctttcggcggcagcgacttggtatgcattaccggttgcaggaattgtgttggttctgctattcgcgattacgatttcataccggcagatcatcaatgcctatccatcaggtggtggggcatatgttgtggccagcaccaactggggacaatctgctggattagtagctggaggatctttattagttgattacatgctaaccgttgctgttagtgtgacttcaggaaccgaagccattacttcggcaattccaagtttgcatgcctatgcggtgcccatcgcaattttgattgtaatcggaattatggcacttaatttacgtggcctacgtgattcagcctcgtttttaactttcccggtatacctgttcatcattatgatcacaattatgattggggtaggctttttcaatattattaccggacgagtagttgcccacgctgcggccagtgttggatcggccgtaccagggatgacagttgtccttttcttaaaggcattgtcatcaggttcctcatccttaactggggttgaagcaattagtaatgcggttcctaacttcaagcgaccacgaagaaaaaatgcggccaacacattagctattatggcgttaattttggctgtcttctttgccggaattacctttctaagttatgctggtggaattttaccaaacgctaatcaaactgtcctttctcaaattggggaaagcatgtttggtcacggtttattattctacttattgcagttatcaacagctttgattttagctgtggccgcaaatactggattttcggcctttccgatgttggcttacaatttggccaaagataaatatatgccccatgcctatatggatcggggagatcgtttaggctattcaaacggtattatttctttagcggtcggagcgattgttttaattatcattttccatggtcaaactagtctcttaattccattatatgccgtcggagttttcgtcccatttacactttcacaatcagggatgatcattcattggttccgtgagcgaaccggacactggttattaaagtcatcagctaatttacttggtgcggctttatcatttggtctggttatctgcttgttcttcttacattttggcaatgtttggccatatctaattgttatgccagctcttttacgtttgttttataaaattcatcaacactacgttaaagtggctaagcagctcagaattgcggctaaaggaaaagttcagctgcatgactatgatggatcaacagtcattgtgttagtcagcaacgtaacgagagtgacagcaggagccattaattatgcccgttcgattggggactatgtcattgccatgcacgtttcctttgatgcggatcccaaaaaagagcgcaaaacggcggttgaattcaaggcagagtatccggatgttaggtttgtggatattcattcatcctatcgttcaattgctaatccaacattacgtttttgtgatgtcattgcacgtcgcgcggcagaaagaaactacaccacgactgtgcttgtgccacaatttgtgccccgtcgaccttggcaaaatattttgcataaccaaactggtttgcgattacgagcagcgttgaattcacgagaaaatatcattgtttcaacgtatcattaccatttaaatgagtaaaaagcttattattttaagtgtgtgaataagaggccgcgcaaaaattatgtttttgcgcggcctctttatatttctaaaatgttggaaaggccagatttttccgcttagtttaggctatacccagaaacaaaccgaattttttctctttcttttgtttgatttaaagtagtcatgttatcttgaattgaacttgtgttacgtttgtggggtttgtataatagttataatatctagaaaagaggtctaacatgcgatttgaaattattgtaagtttatttgctacagcaattatatctgctgtgttaacaccgtttgttagacgactcgcttttaaagttggcgctgtggatgagccttctgcaagacgagtaaacaagattcccatgcccacgatgggtgggttggcaattttcttggcttttaattttgcaactttctttttgttgcgagcgcaaatcccaacccgacagttatggggcatctttggcggcgaatgtatcatcgtgattactggtgtgattgatgatatttttgtgttaaaaccttatcaaaaaatggtcgggatttcacttgcggcaatagaagtctttgtttttgcaaatgtacgaatgaccacgttgacgataccatttttaggcacggttggtttaggctggttgagttttccgattacttatctatggattgcagcaatcacgaatgccattaatttaattgatgggttggatggtttggctaccggagtttcgattattgctctatttacaactggggtaacaggtttgttcttcttaccgacgccaaatatttacacagttgtgatgatttttacactggtagcagcagaaattggctttttgccttataatttctttccggcgcgaatttatttgggcgatactggggctctatttattggatttatgatatccgttttctcattgtcagggttaaaaaatgcaacgtttatatctgtcattattcctgtgatgattttaggtgtgccaattacggataccgtttttgcaatgctacgacgaattttgaataaacagtcaatttcacatgcggataaacgtcatttacaccatcgattgatgcaaatggggttaacgcatcggcaaacagtttttgtgatctatggtatttcacttattttttcatttattgcgttactttatccaatttctcctatttggggctctgttttgctcaccattggaattttaattggtctggagctgtttgtggaggcaatcgggcttgtgggacaggatcggcggccacttttaaactggattcaaaagattgtgacttcgaatacgtctaaagaagccagtaatcaactcgaaactgagcgagaagaaaagcagcgagttgcaaagattagagaagcacaaaagcaagaaaaagaaaaaaaggctagttctgagtctcatcaaaaagataagcattaaaaaatctgtccgattcatatttgggcagattttttaatgcttattatctaaaggaatttcattaaattggttggcttgagattgaaatgaaatgcgaccattgaaaaaatcggtgagctttttttcaaaattttcaacttgtggtgtcgctacaggaaccgtaacttggaccttttcagtgtattgtgtatcctgaatcattagtttatgaacgcttaaccagtgtgtgagtggatcaaactgtgaataatcaatggtaagaagcaaatcggtttgttcaatacgttcaactaacccgatttcatctaataattgcgaggttgaattactgtatgctcggatcaaaccaccagcacctaatttaataccaccaaagtatctggtaacgacgactaaaacgttgtgcacctcatttttttgaaggacttctaaaattggaacccctgctgtccctgaaggctctccgtcgtcacttacccgttgaatatgattatcattgccaagcatgtaagcaaagcaatggtgattagccttgtgatgggttgttttgatttgagtgagaaactggttgacgtctggttcggtttgaatgcgaaatcccgtagcaatgaagcgtgatttttttatctcaagttcatgagagccgttttttgaaattgtaataaaattacttgtcataaaaaatatcacctttcttttacgtatgttattaactggggatgaaaaatggaaaaatctgatttttatggtcgtttagtactcatgtcacgagcagagaaaaatacgacgtttaaactaagaaaaatgccaaccatgcttgtatcagaaaaacgagtgcgttgcctacgatgcaatacttggttagttaaagcgcaagttgcgctaccacatgaagaattttattgtcccgcctgtattcaattagggcgggtaactactttagataatttcttcactttagtggaacccaatcatttcaaaaagttggatcactacttaacgtggcaagggcaattaacaaccagtcaaaaacgctgttcaaaagaagttattcactcgtttcaacaaggtcgagatcatttgctttgggcggtcactggagccggaaaaacggaaatgcttttcccgggaatcaatgaagcacttaaggatggtaaaagagtttgtttggcatcgccacgagtagatgtttgcttagaacttttcccacggctgcaagccgcttttcaacatgtagagattacgcttttgcatgggcggcaaactgaaccctaccgctacacacaattgacaattgccacaacccatcaactattaagattttaccatgcttttgatgttttgattattgatgaggtagatgcatttccctatgcgcaaaataagcaactgttatttgcgacagcacaagctaagaagacaacgggttcctgtttgtttttaacagctactcctggtgatgagttattaaaaaaggttcatcaaaagcaactacaagttagctatttaccgcgtcgttttcatggctttccactgccggaaattcaaacaaagttagccttaaactggtatggtaaaatccaaaacaagaaattgccaagtgccgtgaaacagtttcttaaacagtgtgaagaatctaagcgacaatttctattatttgttccgcacattagtcatctagagtttgtgcaaaaggcagtcaatcaagcttttcccaaattgtacgtgacaaccgttttttcggcagacgatcaacgattagaaaaagtgcaattgatgcgtgatcacgaagttaatgggcttattacgacgactattttagaacgcggggtgactttcccggaaattgatgtttgtgtgcttggtgcagatgatgatactttttcttcagctgctttggttcaaatagctggtcgggtgggtcggagtccgaaacgccccacaggtaacgttttgtttatttgtgcgggactatctcggtctgtgaaaaaagccattcaacaaataaagtttgttaaccacaaggcaaaggaggaagaaaatggactgtctgctgtgtcatcgccaaatacgtgaatcatggccgctaggttttctgatgttaccccaaaagaaaagggttacaacaacttgttcagattgcttagcggcctttcataaaattgatcgggagatgagctgtgaagggtgtggtcggcagcaaaattctcgaaaattatgccaagattgtctaaaatggcaagctaaaacaacttatgatttttcaaatcgagcattatttcaatatgatgaagcaatgaaaacgtatatgcacgattataaattccaaggtaattatcaattacggcacgtttttgatgtcactttttctcattttattggcatgcagacagaggtggactttttagtggctttaccgatagatcgccaaacctggcaaacgcgtgggtttaatcaagtgactggattacttacagagctctccacaacggaccttcttgtgatggatcgtcaaaagaaggaaaaaagacagtcacaaaagaaacgacgagaacgcttgaaaactagtaatcattttcaaattgatgtagaatgtccggaacagattaaaaataaaaggattttgttactcgacgacgtttataccacaggacgaacgcttcgacatgctgccgaaacgctgtatgcggcgggatgtcgcaaagttgacagtgtgacgttatgtcgataataaatttttttcgtttttatttgttaataatagcgttttcatttataatggaattaagcaagatattagaagagtggtcctttcaatatcgtgtttgggcgagcacaaatgcttgctactgaagggagagaagatttatgcttgattttaatgtacgtggcgaaaatattgaagtgacagaagcaattagaaattatgtggaaaaacgcattagtaaactagaaaaatattttgattctagtgtgaatgctaaggctcatgtaaatctaaaggttcatccagacaagacagccaaggttgaagttacaattccacttccatatttggtactgagagctgaagaaacatcacctgatctgtatgcaagtgttgatttggtcactgataagttggagcgccagatccgcaaatataaaacaaaaattaatcgtaaatctcgtgaaaagggatataaaggcgttgaagttcccggtgcagatcttgatgccgatgatgaagatacagattcatctgaatcaaaatttgatattgtaagaacaaaacgtgtttcactaaaaccaatggacagcgaagaggccgttttacaaatggatatgttgggacatgatttctttatctatcaagatgctgaatctgatgctgttaacattgtctatcgtcgtaatgatggccgttatggcttgattgaatctgatgattagttaaataaaataacctgtgaactgaaaagaaagtgatcggtttgagtgtgatttcaaatctgatttcttgattttcagttctttttgtatagttaatgcgaggttcttaactcttttgtttaaaaataggcgtagtaatgttaaaatgttatatggtctacaagtttttagaataacaaatatgtaatttaaaaaatgaaaaagtttagatttaagaggggaactgttgaatggctaatgtattaagaaaatgggttgaaagtgataaacgtgaccaaagacgtttggaccgtttggctaacaaagttgaagcatataaagatgagtacagtcaattatctgatacagatctacaagcaaaaacacctgcacttaaagcacgtttaaaaaatggtgagactttagatgacatcttaccagaagcttttgcggttgctcgtgagggtgccaaacgtgtgcttggtcttttcccattccatgtccaaatcatgggtggtattgtcttgcatgaaggtaatattgctgaaatgaaaactggtgaaggaaaaaccttaactgctacaatgccagtttatctgaacgctttggctggtaaaggtgttcatgttgtcacagttaatgaatacttatctggccgtgacgcgactgaaatgggtgagttatataactggctcggtttgagcgtgggcttaaacattgcagaaaaatcaccagaagaaaaacgagctgcctatgcggctgatattacgtattcaaccaatagtgaaattggtttcgattatttacgggataacatggttgtttaccaagaagatatggttcaacgaccattgaattttgcgatcattgatgaagttgattccattttaattgatgaagcccgaacaccattgattatttctggacaatcagaaaatggtactcatatgtatcgtcgtgcggatcgctttgcaaaaacattgacggctgaaaaagattacaagatcgattgggaatcaaaatcaatttctttaactgataatggaattgaaaaggctgaaaagtatttcaatctagaaaacctttatgatgtggataacgcttcgttaactcatcatttggatcaagcgttacgtgctaattacatcatgttaaaagacaaagattacgttgtgcaagacggtgaagctttaattgttgatcaatttacaggacgagttatgcaaggtcgtcgattctctgatgggctgcatcaagccattgaagccaaggaaaacgttgagattcaagaagaaaccaagaccatggccaatatcacttatcaaaacttgttccgtatgtatcataaactatcagggatgaccggtactgctaaaactgaacaagaagaatttcgtgaaatttataacatggaagttatctctattccaactaaccgtccaatgatcagagatgatcgtcctgatcttctttatccaaccttggaaagtaaatttaatgctgttgtaaatgagatcaagcagttgcatgccaaaggacaaccaatgttgataggtactgtggcggttgaaacttctgaacatttgtcacatttgttggatgaagaaaaaattccacatgttgttttgaatgcaaagaaccatgccaaggaagctgagatcattatgaatgccggtcaaaaaggtgctgtaacgattgcaactaatatggctggtcgaggaactgatatcaagttaggccctggggttaaggaattaggtggactggccgtaattggtactgagcgtcatgagtcacgacgaattgataatcagcttcgtggccgttcaggtcgtcaaggtgatccaggtatgtctcaattctatttatcacttgaagatgatttgatgattcgttttggttccgaacgaattaagaatttattgcaacgacttaaagtttctgatgatgatgcggtgattcaaagtcgcatgattaccaaacaagttgagtctgcccagaaacgagtcgaaggtaataactacgattctcgtaagaatgttttacagtacgatgatgtgatgcgtgcgcaacgtgaggttatttatggcgaacgtcagcgtgttatcatggcaaaaacttctttgaagaatgtcatggtgccaatgattgagcggactgtcaaccaagttgtggatgtgcacacccaaggacctgacaagaagaagtgggatctagaaactattttagattttgctaaatcgaatatggttaatgaagatagtattgggcttagcgattttgcaggtaaaacatcagaggaaattaagggatacttattggacagagcaaaggaaatctatgctcaaaaagaaaagcagctctatgatccagcacaaatgttggagtttgaaaaggttgttattttgcgtgttgttgatgcccattggactgagcatattgatgcaatggaccaactccgtcaatcaattggtttacgtggttatggtcaattaaacccattagttgaatatcaatctgatggttatcgtatgtttgaagaaatggtttcagatattgaatatgatgcaactcgtctgttcttgaagtcagagattcgtcaaaatatccaacgataatttggttcagaaagaaaggttggcatcaaaacactatgttttggccaatctttttttaaggttaaatttaaggagctaaaaaaatggaattaagtgaagcaaaaaagcaaattaatcaaatgaaacaagaagtcgctgactttagggggtcgctttgacttcgataaactaagtgaaagtatttctatcaatgaggccaagatggtagaacccaatttttggaatgatcaagcaaaagcacagaagttaattgacgaaacgaatatcttaaagcaaaaatatgatcagtttcatgatcttcaatcacaagtagaaaacttagaagtaactgaagaacttcttgaacttgaagccgatcctgacatgcaagcagaatttgagaattcatttacgagtacacaaaaaactttaagggaatatcgactgggccttcttttaaatggtaagtatgatgctaataacgctattcttgaaattcaccccggagccgggggaacagaatctcaagactggggatcaatgcttttaagaatgtacacaagatgggcagaacaacacaattttactgtttcaattgaagattatcaggctggtgacgttgccggactgaacagtgtgagtgtggtcattgctggccataatgcttatggttatttacgatctgaaaagggtgtgcaccggctcgtacgaatttctcccttcgatgcggcgggtagacggcacacttcatttgcatccgtggatgttatgccagaactggatgattctgtcgaagttgatataaaaccggatgacttgcgagttgatgtttatcgttcaagtggtgctggtgggcaacatgttaacaaaacttcctcagccgtacggattacgcatttaccgaccggtattgtggtggctagtcaagcccaacgttcacaattgcaaaatcgacaaacagcgatggctatgttgcgtgctaaattgtatgaacgtgaagaacagaaaaaagcagagcagaaagctgctattgaaggtaaacaactagaaattggttggggatcacaaattcggtcgtacgtttttcacccgtattccatggttaaagatcatcggactaactacgaaacagccaatgtttccggcgtgatggatggggatctagatgggttcatcgatgcctatcttcaatggaaactacaacaggcaaatccaaagtaatgtcaggcaaacaagtggaggcgggtttgatgaataaaaagatcttaattgtcgatgatgagccttcaattgttacgttacttacgtataacttgaacgaggctggctttcaagttgaaagcgtcggatccggtttacaagctttggcttggctaagaaccaagcaagctgatttgattgtgatggatttaatgttgccaggaattgatggcttagaggcaattcgacgcatccgaggaactcaagaagaaacaccaattattattttgacagctaaaaataacgaactagataaaataattggttttgaaattggtgcggatgattatctgacaaaaccatttagtcctcgagaactagtggcaagaattaaagcaattttacgccgaacggaaaatggtcaaaaaaaggttgcgccgattgagaccagtcaagaaattcggtatttaggtaatctttcgttaaatttagaccgttatgaagtccaaaaaaaccaccaaaaagtagccttaacacctaatgaatacaaattgctggtttatttatgggatcatgcggatcgggttttaagtcgcgaacagatattaaatgccgtttggggttacgattatgcaggccagacgcggatggtggatattcacattagtcatttacgcgacaaaattgaagatgatcccaaaaatgcaaaattaattttaacagtgagaggctttggatatgaattcaatacaaaaaagactgctgaatagaacgttacgtttttttctgactagttttgtcgggaacctgttgatggcttttttagtgttaagagcagttcaaaaggggcagcatagttttagtacaaaagaaattaactatatcttactgtttgctattacaatttttgtgactgctattgaagtagttgtttattggagtaatttgcgccagtcgcaaatgcgtcaagacgctttaaacgaaaaactgcaagaagttttgaatggtgaaaaagctagccaaattgtgttaccaaaagatgatccgttttatgaactcacgatgaccgtcaacaaaattgaatcccatgatcgccatcaaatccataatctgacgaatcaaggtaatgaactaaaagccattgtgaacaatttaccggtgggtgtgttggtaattaatcggcatcgtgaagtccaattggcgaacccggctacggtagatttattgcagttgcaaattaaattggatccgcacccttatacaatggatatcaaacaaagagaacttcaggcattgattgaacgaacttttgagacgaaacgcagtcatcaccggacccttcacttgaaacgagaacctagtgaaaaagtggttgaggcaaccgttgtttataataaacaagttcaccatcgttttgaggtgattgtgttattgtatgatattactgaggcttggactgtggaacaaatgcagttgaattttgtcagcaatgctagtcatgagctaaggacgccaataaccgccatttctggatttgcagaaactctgatgaatggtgcgaagaatgatccagacaaattggatgaatttttaagtattattcaaaaagaaagtcgaaaattagttcgattggctgatgatattttatcaatttcaaggacgcaatcagatgatgaacagtcattacaaatttcggattgtgagttagccgctttaggacaggaagaaattgatcttttgcatcgtgggattcagctacaccaggtcacggtctccaataagattcctaaggatgtgacagttcaaactgattctcaacagttaggccaaatcattaaaaatttggtggccaatggtattcgctataatcaccctcatggacaagttacgttatcctatgcagagactaataatcgctggcaactaattgtagaagatgacggaattgggatcgcagctgatgaacaacataaagtttttgaacgtttttatcgagtcagttccaataaatcaggtgaattaatcagtggtactggtttaggactgccaattgtagctgaaagtgtcaaaaacctaggtggcgaaattcgcctcaattctgaagtgggtaagggttctaaatttattttaacctttcctaaaacttggcatccaaatacagaaatataaaaacattactaatatacaggcactaaatcatgacaaggttcgtgatttagtgccttttttgcgttttaatctttacacaacctttacatgaacaacatgatagctaaacacacagtagataaactcaagatgtaacgtcgagaggagatggaataaatgaagcgaattataggggtaattcttgcggttggaatattagccgttggattagtcgggtgtgggactaagaagggacacgcaatcacaattgtggggtcaacagccttacagccactggttgaacgagctgctagtaactatcaactcgtaaattcgaatgtggcgattaccgttcaaggcggaggttcggggactggtttgagtcaagtccagtctggagccgtcacaattggcaactcagatgtttttgcagaagatcaagaagtaatcaaagctgcaaaattagtcgatcataaagtggctgtggtgggaattacgcccattgttaataaaaaagtcacagtaaaaaatttaaccgctaagcaacttcgtcaaatcttcacaggtaaaattacgaattggcaacaagttggcggtaaaaagcaaaaaataacagtaattaatcgatctcaaggaagcggcattcgaaacacctttgaagcaattgttcttgctggtaaaacagcattgcgctcccaggaacaagattctaacggcaccgtccaaaaaattgtagcggccactcctggagctatcagctacacgtcattttcatatgtcaatgaccaagtaaaggcattgaaccttaatggtgttcagccaattgcagcaaacgtcatgacgaatgcatggccaatttggtcttatgaacacatgtataccaagggaaaacctgatgtgcaaaccaaacagtttttaaattatgtcagatcaccaaaaaatcaaaaaacactaattactgatctaggttatatttcaattcatgatatgaaggttactcgagattatcacgggaaccttcggcataaatagaaaggagtgtgaaaagtttggataagatcaaacgacaattaacaagttcttctaaagcaacccgacaagatcgaatcggaaagctagttgcctttttatgtacttttttgattgggctacttgttgtttccattttctatatggtagcttccagagggttagcgaccttttttaaagatcatgtttccttgtgggactttttaagtcatcagaattggaatcctagtcaagttggcaaggatggcacaccagaagtgggtgctttaccaatgatcgtaggttccttttctgtgactgttttatcagctattttagccacgccgtttgcggtctccatggcattgtttatgaccgagattgcgccaaagagaggacaaaaagttctccaaccagttattgaactattggtaggaattccctctgttgtttatggatttgtaggattaacgattgtggttccagttgttcgtgcctttggcggaggaactggatttggaattttatctgggacactcgttttgtttgtcatggtgttacctacaatcacctccatgtacgtcgacagtttacgatcggtgcccggtttttatcgtgaagcagccttggcactaggggctacgcgttggcaatccatatataaagttattttgcgagcttcagtacccggattgttgacggccataatttttggaatggctagagcatttggtgaagctttagccgtccaaatggtcatcggaaatgcttcattgttgccacacaatttgatctcacctgcttcaacgttaaccagtgtcttgacaacaggcattggtaacacggttatgggcacactgcctaacaatgcgttgtggtcgcttgccttaatcttgttattgatgtcgctagcatttaatctgctggtacgtgtgatcggaagcaaagggaggttaacgaaataatgaatgcaaaaagaattgataaactggccacagccgttatcagcctcttagttggtgttgtggtgttaattttattgtcattaattggatatattttggtaaccggattaccgcatatctcatggcattttttaacttcaccttcccaagcttttttaaagggtggcggaattggtgatcaactatttaattcattttatttgttggttctgacgcttgtaatttcattcccaattgcacttggggcgggtatttacttatttgaatatgcacctaaaaattgggtgacaaataccattcgcgtagcaattgaagttcttagttccttaccttcagtggttgtcgggttgttcggatttttattgtttgtggttgaatttaagctaggtttttcaatcttgtcgggggcgattgcattgacgtttttcaacctgccgcttctaacccggagcattgaaaactccttaactgctgtcccaaaactacaacgagaagctgggttggcgttaggattttcacgatggcaaacagtattaggggtaatttttcctgaagcattgccgggaattttgacggccgtaattttaagtgcgggtcgaatttttggtgaagcggccgcgttaatttacacagcaggtcaaagtgccccaattttaaattttgccaactggaatcctttcagtccaactagtcctttgaatccaatgcgtcctgccgaaacacttgcagttcacatttggaaaattaattcagagggaattatgccagatgcaagcgcagtatcggccggggcatccgccgttttaattgtggttgtgctcctctttaatttttcggcgcgctggctaggcaatcgaatttatcgaaaaatcacggcgtccaaataaatgaggtggtttaattgaaaaaatattcactaacagaaaattatattcacaaatttgatccaaataaaaccaccattgggttgtcaaccgaggatttacaggttttttatggtgattatcatgccatgtatgatggcaatttacagtttcctaaaaatgcgattacagcaatgatcggggcttcgggttcgggaaaatcaacttttttacgctgcttaaaccgaatgaacgatgatattgcgacggtaaagggcaaaattgtgtatcaaggaattgatatcaatgcaccagaaatcaatgtttatgaaatgcgcaaacatgtgggaatggtttttcaacgacccaatccgtttgcaaaatccatctttaaaaacattgcctatccgttgcaaaaggcgggaattaaatcaaaggttgagctaaaagaacgggtggaaaaaagtttacggcaagcagctttatgggaggaagttaaggatgatttgaatcgtagtgccttggctctttcaggtggccaacagcaacgcctgtgtattgctcgagcattagctatgaacccggatgtgttgttgctggacgagccggccagcgctcttgatccgatttcaacgggaaaacttgagcaggctttgtttgaactaaaaaatcagtacacgattattatggtgacacacagtatgcaacaggcttcgcgtactagtgattatacggcttttttccacatgggacatgttcttgagtttgatcgtacagaacgcatttttaccaaacctcatattcaagcaactgaggattatatttctgggaattttggttaaccggaactttgtagaaggagaaaaacatggcaaatataattacaactcgcaatgtgcggctatattatggagatcatgaagcgctgcacggaattgacttagattttcctaaaaatcaaattacagctttaattggtccttctggaagtggcaaatcgacttttctgagatgcttaaatcgaatgaatgatcttgtaagtggcgtaactattactggtagtttaaaattagatggtaaagatatttacagtcctcagaccgatgtggtggcgttacgtaaaaaagttggaatggtatttcaacaacccaacccattcccgttctctgtttttgacaatgtggcatttggcctacgattagctggcataaaggatcataagtcaattcaggaacgggtcgaaacgagtttgaaacaagcagctgtttgggaggaagttaaggataatttaaccgataatgccttatctttttcaggtggccagcagcaacggatttgtattgcccgtgttttagcagttcagccagaaattattttgatggatgagcccaccagtgcgttagatcccgtttcagcaggaaaaattgaagaattattgttggacattcaggacaaatttaccgttgccattgtgacgcacaatatgcaacaggcttcacgaatttcagatcgaacggcatttttccttgatggaaaattagtggaaacgggttcgaccaaacaattatttatggcaccaaagcaagaagcaaccagtgattatttgaatggaaaatttggctagacggaggttatgaagatgcgcggaatttttgaagatgaactcaaaaaattgcatggaaaatttactgaaatgggaattaatgttagtgaggccatttatcgggcttcaaaatcatttattgatcatgacaaattacttgcgcaacaggttattgatcatgatgaacagattaatgaggaagagatcaaattggaagaccaagccttaatgttaattgcattacaacagccagtggcaacagattttcggcggattatcattgttttaaaggcgagttctgatttggaacgcattggtgatcatgcggtagggatcgctagagaatccattcagttaaaaggtgaacaccggattgaggaaattgaaaacgaaattggcgaaatgaccaataatgtgcgttcgatgttagaggaagttttggatgcctatgtcaaagaagatgagatgggtgctaaaaagattgcgagcgcaaatcaaaaaattgacgaggactatgcggaagttcgtgaaaaaacaattaaaatgatgaaacaggattcaaaagtgatcacaggaagtgcaagttacttgatggttgctagttatttagaacgcattggtgatcatattgggaatattgcggaatgggtggtttacaatgaaacgggtcatcttgcagaattaaccccagatcatcatccagaagaaaaatgaatgatagacttgatagatgaaagtttaagaatctatcaagttttttattttaggagttaagtttgccaatttagctacacaagctgtagaatataattaattaacaacttgaggtgaataacttatgaaatcaaatacaaaacgaaaatttacaaaatcaaatagtcgaatggtatcaggtgtcctaggtggaatcgcaaatttctttgcgattgatccttcaattgtgcgggtcgtctttgttattttgacattaatctcgcatatttggccaggaattttaatctatgctttactggcttggttaatgccagaaagtcaagaacaacgtaccagcggttttacagaaaacttctttactggttttgaccaaccacaacaaaaatcacaatcccgaaaacgaaaagttattaaagatgtgcaagaagaggacgatccaacttctaaacatcaaaaataggaggagggtgccttatgaagttttggcaaagagtagttgccgatgcaattatttttattgctttggcaggattttatcgaaatagcggtaattttgtggtcaccagtgtctgggttgcccttggtgctagtttagttttagctattttaaatgcatcagtcaaaccattcttacagttgatttccttaccaatcacaatattgaccctcgggctttttagtattgtgattaatgcggttatcttgcaattaacttcggttctagtaggatcagctagtttctatttttcatcgtttggaatgactatgtggattgcactgctgatgtccattttaaatgcgattatttcgaattattttattaatcgatagtgcgtcatgtcataaaatcacagggggttttattttggcagatagtgtgaaggtagcagatcttgtaaaatcaacaagactagatgtttattccggaaaaaaatttttaacaaaacgggatattacagttagtgatatttcacgacccggtttagagttaaccgggtattttaatttctatccacatgaacgtgtgcaactgtttgggcgtaccgagatctcttatgcaaaaggcagtatgaccagtgaggaacgtcttgatgtttatcagcgtatggcccatgatgacacaccagcatttgttatttcgcgtgggttaccaattccagaagagctaacgacggctgcaaaggcaaaaaatatacctgtcttgggttctgccttacctacctcgcggttattgagtaatatgaccaattatctggaaggtaaactggccgaacggcaatctgttcacggggaactggttgatatttatggacttggtgttctgattactggagactctggggttggtaaaagtgaaacggcactggaactggttaaacgtggacatcgtctgattgctgacgatcgtgtagatgtttatcagcaagatgaacaaacgctggtgggcgaagcacctaaaattttacgtcaccttttggaaatccgcggagttggaattattgatgtgatgaacttgtttggtgcgggtgctgtgcggaccgaaacggatattaacttgattgtgcatcttgaaaactgggatgatgataagcaatttgaccggttaggtaatggacaacaaacacgtaaattctttgatgtcgaaattccaaggatcgcgattcctgttcgtactggacgtaacttggcagttattattgagtcagcggcgatgaactttagagccaaaaatatgggttacgatgcaactaaggtttttgacgagaatttgaacgagttaattaaagataattcgaagaacaactaacaggagatgacgggtatgaaggtatttttaggggcactaaacccaattgcattaaaactgggtccttttgagattcactggtatggtgtgattattgccagtgcggttgttattgcaacattcttggctgttcgtgaaggaaagaaaagacaaatcgatcccgacgatatttacgatatgattttgtgggcgttacctgccgctttaatagcggctcgcgcctattatgtagcctttgagtggtcttattattcccaacatccaagtcaaattattgctatctgggatgggggaatcgccatctacggatctttaattggagctggtttggttgtttatttcttctgcaaatccaaatggattccagtttggctcatgcttgatgttgcaggacccgtagttttgatggctcaaggaattggtcgctggggaaacttcatgaatcaagaggcttttggacggatcacgtccctccagtttttgcaaaatttacatattccccattttattgttcaacagatgttcattaatggtgcctatcgtcaaccaacatttttgtatgaatcaatctgggatatcttgggatttatcctgttgatgagttttcgccatcgaaaacatttatttaagcaaggtgaagtttttcttagttatgtgatttggtattcatttggtcgcttctttattgaagggatgcggactgatagtctaatgattggaaatgtgattcgggtgtcgcaggtcttgtcagtgattttgtttgtcggtgggctgacgttctggtttattagaaggaaaaagctgacaaataatccttggtatttagatggaaatgaattaaatccgcagaaaagttgagtaatcgctgggattgttagataatggaaaagtagaacaagaaatgattaattataaggagttatattgatgtctgagaaaattgcggtattaggtgctggttcatggggtagtattttggccaacctgttaacagagaacggtaacgatgttcgtgtttggtcaaatgcaccggaacaagttaaggaattaaacgaaaagcacactaatgaacactatgttccgggatttaagtattcggataagttagttgcttatgatgatctagaagcagcgctcgatggagttgcagttgtcttgtttgttgttcctactaaagtgatgcgcttggtagctaacgaaatggtcgaagttttagaaaaaactggcaacaaaccaattatcgttcatgctagcaagggattagagcaggggacgcacaaacgcctttctcaagttttggaagaagaaattccagaaaagaatcgtcaagctatcgttgttttgtctggtcctagtcatgctgaagaagttgctaaaaaagatattactttggtaacagctgcaagcacagatcaaacagcagcacaaaaaattcaaaaattatttatgaataagtacttcagagtttatacgaacgatgacatcattggagttgaaacgggagcagccttaaagaatattattgctttaggtgctggtgcccttcatggcttaggctatggtgatgatgcaaaagccgctttgatgactcgtggattggcagaaatcagccgtttgggagttgccttaggggcaaaacctttgacttttatcggtttatctggagttggtgatttgattgtgacggccactagtgttcattcacgtaactggcgtgcaggtaatgaattaggtcaaggaatgcccttaaaagaagttattgatacaatgggcatggttattgaaggaattccttcaacgcaagcagcttatgaattggcggctcaaaaccatattgacatgccaatcaccaatgccatctatgatgttttatataatggtaaagatgtaaagaccgccatcgaagaattgatggatcgcgaaggcaaacccgaaattgagtaagtagattttaaataaaggagagttatttatgtcagatagagttagaaaagcaatcattccagctgctggattaggaactcgttttttaccagctactaaggcttcacctaaagaaatgttgccaattgtggacaaaccaaccattcaatttattgttgaagaggcccgtaaagctggaattgaagacattttgattgtcactggtaagggcaaacgtgctatcgaagatcattttgattctgttccggaattggaaagcaatttgaaagccaagcacaaggataatcttttaaaattggtcgaagaaacgactgatattaatttgtactttatccgtcagtcacatcctcgtggattaggtgacgccgtattaatggcgaaggattttgtgggtgatgaaccatttgtggttatgcttggtgatgatttgatggaagataaggtcccattaactaagcaactcatgaattcttacgaggaaacacatgcttcaactttggcggttatgcaggtccctcataaagaagtttcaaagtatggtgtgattaaacctcaagctaaaattaaacctgatttatttaacgttgaaagctttgttgaaaagccaatccctgaagaagcaccaagtgactatgccatcattggtcgctatttgttgacaccagaaatttttgatattttggaaaatcaaaaacctggtaaaggcaacgaagttcaacttacagatgctatcaacgagcttaataaaacacaacgggtatttgctcacgtattttcgggcgaccggtatgatgttggaaataagtttggtttcttaaagacgaacattcaatatggtttgaagcatcccgaagtaaaagatgatttacgcgaatacatcaagcagttaggtgctaaactaactgcagaagataaagttagcaaaaaatcaaaataattaagaaatcaaaataggtctgaatagaaactggcaattaccggaattctctggaattgccagtttcgttatcgcaaggagaaacgaactaactaattgtaagcaaaatgttagacattttgataagaagatagtatattattatcattatcaattgagagaaggggaaagtacttggcaaaagaatatgacgttattgtaattggtgcgggtcctgccggaatgacaaccgctttgtacgcttcacgtgctaatttatccgttctaatgttagatcgcggaatttatggcggtcagatgaataatactgcagcaattgaaaactatactggtttcaaatccatcttaggaccagatttggctaaagacatgtatgatagttcaattcaatttggagcggaatatgcctacgggagtgttcagtcaatcgaagatcatggggatgttaaagttgtaaagacggataccgacgaatttacaacgaaggcagttgtgctcggaaccggttctgaatataagaaactcggtgtgactggcgaggatacctacagcggccgcggcgtttcctattgtgcggtatgtgatggtgccttctttaagggcatgcatttaatcgttgttggcggtggggattctgctatcgaagagggaatttatttaacccagttagcttcaaaagttactgttattcatcgtcgtgatcaattacgtgcacaaaagatcactcaagaacgtgcttttgctaaccctaaaatggaatttgtttgggatagcaatgtcactgaaatcttgggtgacgatcaaaaagttactggtgttaaagttaacaataataagactggtgaggacagtacgattgaagcctctggcgtgtttatctacgtgggtaatcatccaatgactgacaacctgcataatctcccaatcttagacgaaaatggctggattccaacagatgatcatatgcagacgaaagttcccggtatctttgctgttggtgatgttcgccaaaaggatcttcgccaaattgcaaccgctgttggtgaaggtggtatcgctggacaacaagttttctcatacattcaagatttaaaagctaaagctactgtcaaataaacaagtaaagtttcgggaatactaatttctcgaaactttttttgagttaaaaaagtatcggaggaaaccgatatgactaaaaatttgcctataccaaagaaaacttttcaatcaaccagctggtttgttgtatacttaagatgttgaataaaatacgccaatatttgggggtaaaaaacgtgagttggaaagatacctatcaatcatggatggaacgggttgatttagaacctggattaaaaaaagaattagatcagttggcaggagaagacactgacttagaagaagcattttatgcaccaatggaatttggaaccgctggaatgcggggggtcatgggtcccggaattaaccggatgaacatttatacagtgcgtcaagcgacagagggacttgcaaacttcatggatgagctggatgaaaagacgaagcaacagggcgttgccattagttttgattcacgttatcactctaaagagttcgcacatgaggctgcacacgttttgggtgctcatcatattcctagttttgtgtttgatgacatgcgaccaacgcctgaactatcttttacagtccgtcatttgcatacctatgctggaataatgattacggcgagtcataatccaaagcaatataatggttataagatatatgggccagatggtgggcaaatgccacccgtggattcggataaaattacagcgtatatccgcaaagtaacggacatttttgatgtccccgttgctgacgagcatgaattacgtcaaaatggcttacttaccttgattggtgaaaatgtggatgaggcatatcttgccgaagtaaaaaccattacgattaatccggatttgattaaagagtatggagcagacatgaagctgatttacacaccacttcatggaactggcaaagttttaggcaatcgtgctttgcaaaatgcgggatttaatgattttacaatggttcctgaacaggcaaccgcagatccagaatttattaccaccccatttccaaatccagagtttccacagacctttgatttggccattaaactaggtaaaaaacaaaatgctgatttactggtagcaacggatccagatgctgatcgattaggggccgcagtacgtcgaccaaatggtgagtatcaattactaacaggtaaccagatggcagcgttaatgctcaattatattatgactgcacggcaggaaaatggcacattacctaaaaatgcagtggcagtaaagtccattgtttctagtgaactggctaccaaaattgctgaagcacatggggttggcatggttaacgttttaactggatttaaattcatcgctgatcaaattcaacattatgaaacgactcatgagcatacttttgttttcggattcgaagaaagctatgggtatttggttaaacccttcgtgcgtgataaggatgccattcaggggattgtgatgttggcagaaattgcggcttactatcgtaaacagggaaaaaccctttatgacgggttacaagatctttttgcaaaatatggttattatgcagaaaaaacgatttcaaaagattttcccggcgtcgatggtaaggcagagatggccaacttaatgacgaagtttcgggaagaacgtccgactgattttgcgggtcaagaagttaccgctttggaagactttgaaaaacaagtgacaacgtttgcggatggcacaagcagaaagattgctttacccgtttcaaatgttttaaagtatcaacttaaggacggtacttggattgctattcgaccatctgggacggaacccaaaattaaattctatgtgggtactgtgggatcagacaatgcaattgctcaaaagaaagttgctgattttgaaaaggcaattgacaaatttattgaagcttaatttaaacttcttcggataaaatttgactaggaggccgctgatgggaattcaccaatatatcaagagtttaagtaatttagagactttagtgcgtgcaccaggaatttttaaatatcagaagcattcagttgctgagcactctttcaaggtaacccaaattgcccaattcttaggtgatgtggaagaaaataaaggaaataaagtcaactggcaatcactttatgaaaaagctttaaaccatgattataatgagcgatttattggtgacatcaaaacacctgtgaaatatgcgacgcctaaattacgatcgatgttggctgatgtcgaggattcgctttctgaaagttttgtgaatactgaaattcctagcgaatttcgaagtgcttatcggcggcgtctttctgaaggtaaggatgacactttggaaggtaaaatattgtcggtagctgataaaattgatctcctgtatgaatcttttggtgagattcaaaagggaaatccggaagcaacctacgaggaaatttataaagaaagtttaagtaccattgtaaagtttaaagagctagcatccgtgcagtattttttgcatgaagttttaccagatttattgcgggaaaagtttactgatcaggctaagttaggaaaaattacccagcaaattatcaagtaaacaagatgatagcgaaagtatgttcggtatggtaaaattgaatacattgttgaagaggaaggcaatcgctttccttttttttgtgaacgaaatggagggtcttctcgatgatagatcgtactgataataataagtttgacttagtttcaaaatataaaccgactggtgatcagccaaaggcaatccagcagttagtggctggaattaatacgggtgaaaaagcccaaattttgttaggggcaactgggactggtaaaacttttaccatttctaatgtgattcaacaagtgaacaagccaacactagttttgtcacacaataaaactttggcgggacaactttatggtgagttcaaacaattttttcctaacaatgctgtggaatattttgtcagctattacgattattatcagcccgaagcatatgtaccatcaagcgatacgtatattgaaaaagactcttcaattaatgatgaaatcgataaactgcggcattcagccactagctcattattggaacggaatgatgtcattgtggtggcgtccgtttctagtatttttggattaggtgacccaactgagtataagaaccacactgtatcattacgagttggccaacaaattgaacggaatacgttacttcgtcaattggttgatatccagtttgaacgtaatgacattgactttcaacgtgggcgttttcgtgtgcatggggacgttgtcgaaattttcccagcatcacatgatgaaaaagcgttaagaattgagttttttggcgatgaaatcgatcgaattcgcgaagtggacgccttaactggcgaagttgttggtgaccgtgaacacgttgccatcttcccggcaacccattttatgacaaatgaagatcaaatggaagttgccattcaaggaattgaagcagagttgaaagatcgtttacaggttttagagtctgagggaaaactccttgaagctcaacgtttaaaacaacggacaacctatgatgttgaaatgatgcgtgagatgggttacaccagtggtattgaaaactattcgcggtttatggacggtcgcaaaccgggagaacccccatatacgctgttggatttctttccaaaagatttcttgacggtggttgatgaatcgcatgtgacgatgccacaagtccgtgggatgtacaatggtgatagggcacgtaaacaacagttaattgattatggcttccgattgccaagtgcgttggataatcgaccgttaacactaaaagaatttgaacaccatgtgaatcagatcgtttacatgtctgctactcctggaccttatgaagaagagcaaacgaatcatgtggttgaacaaattattcgaccaactggtttattggatcctgaaattgaagttcgcccaattatggggcagatggatgaccttgtgggtgaaattaataaacgatcagaattaaatgaacgggtctttgtgaccactttaacaaagaagatggcagaagatttgactgactatcttaaagaacttggaatcaaggttgcttatctgcatagtgatatcaaaacgttagagcgaacgcggattattcgtgatttacgaacgggcaaatatgatgttttagtcgggattaatttgttacgtgaggggattgatgtaccggaagtgtcgttagtggctattttggatgcagataaggaaggctttttgcggaatacccgttctttaattcaggtttctggacgagcagcacgaaatgttcatggacgggttattatgtacgcagacagtgtcacgcaatcgatgcaagaaaccattgatgaaactgcccgccgtcggaaaattcaggaagcttacaacgaaaaacacgatatcaccccccatacgattaaaaaatcgattcgggatcttatttcgccaacgaaaacaactgaagatacaggtaaaaaagatgatttcttagagactgatttcgacgatatgtctaagaaagatcaaaaacaaatgattgataatcttactgaacaaatgcgttccgcagccaaaaaattagacttcgaaacggcagctacattacgtgatacaataatggaattaaaagccgaaataagttagggggtattgatttggcaaacgataaaattgtcattcatggagctagagcacataatttaaaggatattgatgtcacaatcccaaaaaataaaatggttgtgattacaggtctttcaggatcaggaaaaagttctttggcatttgatactttgtacgcagaaggacaaagacgctatgtagaaagtttgtctgcatatgcacgtcagtttttaggccaaatggataaaccagatgttgattcaattgacgggttaagtccagccatttcgattgatcaaaaaacaacctccaaaaatccccgatcaacagttgggacagtgactgaaattaatgactatctgcgattactatgggcgcgtgttggccacccaatttgtccaaatgatggaactgaaattaccagtcaatccgtagaacaaatggtggatcgtgttttggaattgccagaacgcacaaaacttcaaattatgtcacctattgtccgtgctaaaaaaggtcaacataaaaaaatctttgaaaaaattaagcgtgaaggttttgtccgggtccgtgtggacggtgaaattcatgatattgaagaagaacttgatttaaacaaaagcaaaatgcataccatcgagattgttattgatcggattgtgatcaaaaaaggtattcggtctcgtttgtttgattccttcgaagctgcgttacgtttaagtggtggatatgctacagctgacatcattgatggagaatcccttttgttttctgaacattattcttgtccaatttgtggatttacagtgggtgaattagaacctcgtctattttcatttaatgcgccatttggggcttgcccagattgtgatggcctaggagttaaattggaagttgatatggatttagttgttccggacccatctaagactttaagagaaggggccttggcgccttggaatccaattagttctcaatactatccaagtttgcttgaacaggcttgtgaggcatttgggattgatatggatacgccatttgagaagttaagcagtcaggatcaaaaaacggtgttacatggttcaaatggcaagcaatttcactttcattatgaaaatgattttggtggtgttcgtgatgtggatgtggcatttgaaggggtcattgaaaatgttgatcgccgttatcgagaaacaaatagtgactttacccgggatgttatgcggggctacatgcgcgaattaacttgtcagacttgtcatggctatcgattaaatcgaaaagccagaagtgttaaagtcatgggcgaacatattggtgaagtttcggcgttgccaattgacgatgccattaacttttttaaccatgttgagttgtcagagcaagaaagttcgattgccaagccaattttaaaagaaattcgtgatcgcttaaccttcctcagaaatgttggtcttgaatatttaactttaagccgggcttcacgaactttgtctggtggtgaggcacaacgaattcgtcttgcaactcaaattggttcaaatctttctggtgttctgtatattttggatgagccgtcaattgggctacatcaacgcgataatgatcggttaattggatcgcttaaaaagatgcgcgatctagggaatactttaattattgttgaacatgacgaagatacaatgcgagcggctgattatttaatcgatattggtcctggagctggtgataacggcggtaaagtaatggctgctgggacacctgctgaggttgcaaaagtaccgacttctttgactggtcaatatttggcaggaaagaagtttattcctgttccactgaaacggcgtaaaggaaatggcaaaaaaattacaattaaaggtgcagccgaaaacaacttaaagaaaattaatgtcgattttccgctgggaaagtttattgcagtaactggtgtttcgggatctggtaaatctacgttggttaatatgatcttaaaacgtgttttggcacaaaaattaaatcgtaactcagaaaaaccaggtaaatatcgttcggttgctggcgtgaaaaatattgaaaagataattaatattgatcaaagcccgattgggcggacgccacggagtaacccggcaacttatactagtgtttttgatgatattcgtggtttatttgcccaaactaatgaagctaaactacgtggttatcataagggacgctttagttttaatatcaagggtggccgttgtgaagcttgtaaaggtgacgggatattaaagattgaaatgaatttcttacctgatgtttatgttccatgtgaggtttgcaaagggaaacgctataactcagaaacgcttgaagtgaaatataaaggtaagagtattgctgatgttctggaaatgactgtcgaagaagccttggacttctttgaacccattccaaaaattcggcgtaaattacagaccattgtagatgttggcttaggttatgtgcaattggggcaagctgctacgacactatctggtggagaagcacagcgaatgaaactcgcttctgaactgcataaacaatctgcaggaaaaagcttttatattttggatgaaccgactactggtttgcataccgatgacatcaaacgattgcttgatgttttacagcgattggttgataaaggcaatacggttctagtgattgaacataatttagatgtcattaagacagccgattatctaattgatcttggtccagaaggcggggccggtggcggttcaattgtagcaactgggactccagagcaggtggcagaagttaaagaaagctatactggacagtatttgaagccggttttggaacgtgataagcaacggacgatggaagtgtcagaaacaaaaacaactaattaactataaagggatggtgaaagcagtgaatcgtgaagatggctggggatttgattggtctgagctaattaccgggatcattttcctgatcgcaggatactttgtttttcgtttaccacaagtggcaattaccagcttagctattgtttttggaattgccgcggttgtccgtggtattacaatcattggtgggtaccgacgtttaaaaagagcaacaggaactaaagcaaacttagcacttggtttgggaatcgttgatatttttataggtgcgatctttatgtttgatataccgagtgccattaccttcttgagttatttgtttgcattttggttttttgttgatgttgttgagcgattggtcgtaagtaatcatctgaagatttttggcaatggtatttattggttgtcagttataattgatttacttcttttagtagtggcggttgtactattaattcggccgatgctaacgatcttgactttgaatgcaattgttggtttttatcttgtgatttttggtgtaaatgcaattattattgcatttgcgcgaaaaaataagtgaattaaaaaaagtcgaagcaaatgtgataaagttgcttcggcttttttactaaaatagaaacaaagacgggttttacttaaaatggcacacccggtgtgctataattaggaatcacgatcgggggatttaaaatgacagatgaaaaaatgcaattagtcattgttactggaatgagtggtgccggtaaaacagtagctatgcaaagttttgaagatttaggcttcttctgtgtggataatatgccgcccgcattgttgccaaaattctgggaactggtgaaagaatctggaaaaatcagtaaagtagcattggttatcgatttaagatcacgtgcgttttatgatcaaattctgcatatgctaactgatgaaaacgaaggctctccagctattgagtcccaaattttgtttttggatacatcagataaagaattagtttcccgttataaggaaactcggcgttcacatccattagcaatggaaggtcgtgttgtggatggtgttcgtaaagaacgggagttattggcaccaattcgttcaaatgcgcaatacgtcattgatacaacgaccatgacgccacgtgaattacgagaacaaatttttgaaacttttgggactgaaggcacagctggaaacttccacgttgaagttgtttcatttggttttaaatacggtttgccaattgatgctgacatcgtgatggatgtccgtttcttgccaaatccctattatgatccaaaattaaaaaataaaactggtttggataaacctgtttatgactatgttatgaagcaaccggtaacggaaaagttttatagccatttcatttcgctattgcgttatgtcatgccggggtatcaaaaagaaggcaaatcaacggttacgattgccatcgggtgtaccggtgggcaacatcgatcagtcgccatagctcaaagaatagctgatgatctaactgctgattatactgttcatgttcaacatcgggatgtgaataaacgaaaggaaactgtgaaccggtcatgacaaagagacaagcagcaaaaaaccgtcctaagtttgtggtgattggtggcggaacgggcttgcccgttatacttaagagtttaaaaaaacaaaatgctgatattactgcggtggttaccgtggctgatgatggggggtcatctggcgtcattcgaaattatgtaaacgttgtgccgcctggtgatattcgaaatgttattgtggccctttctgacttaccaaaattggaattagatatttttcagtatcgttttaaaagcaatgatagctttttgtcaggccatgcgattggtaacttgattattgcagccttgtcagaaatgaagtctggtgtttttacagcagtgcaagaactttctgaaatgatgaaagtcgatgggcacatttacccggcttcaaacgaaccattagttttgcatgctgaatttactgatgggacacaattagcaggtgagtcagaaattacggcggcgcacaaaaccatcaaacgggtttgggttgagccaacttcttggaatgctgacgaaaagccacatgccgttcaggaagccattgatgccattttagatgctgatgaaatcattttaggccccggcagtttgtttaccagtattttgcccaatcttatgatttcaaatatcggggatgcagtcctaaaaactaaagctgaagttatctatatttgcaatattatgacgcaaaaaggtgagactgataactttacggattctgaccatgtcgcagttttgaaccgccatttaggtcaaaactttgtggataccgttttggtaaacacggcaaaagtgcctgacgattatatggactataatcgttatgatgaatattcgacacaagttcggcctgattttaaaggattacgtgcccaaaattgtcgagttgtttcagataactttttgtgtttacgtgatcatggcgcgtttcatgatggggatcgggttgcagaagaattattaaacgttgcgggtaatcctaaggcctgtgattaaattttgtgaagggagggattttcgtgtcttatgcgagtgaagtaaaaaaggaattaacggggattaaggtacatcaacaaaacgcaaaagcagagttaatggcgttgattcgtatgaatggatcaattaatttggcccatcatcaattagttctgagcgttcaaaccgaaaatcctgccattgcgcgcagaatttatgcactgttaaaggatttttattccgttgagggtgaactaattgttcgacgcaaaatgaaattgaagaaaaacaatttgtacattgtgcgtttaatgacaaggtcccaggcaattttagaggatttgtcaattttggccgatggttatcaaattaatgaaaaggttccggatggtttattaacgacggaaggcgaaatccgctcatatttacgtggtgcttttttggcgggaggctcagttaataacccagagactagtcggtatcatttggaaatttattctctttacgaaactcacaatgccatgattatggactggatgaaccgttatgatttgaatgctcgagcgacggaaaggcgaagtggttacattgtttatctgaaagaggcagagcaaatcgctaatttcttgtctttaattggagcaacaaattcaatgctgaaatttgaagacattcggattttgcgtgacatgcgcaattctgtaaatcgactggtaaattgtgaaaatgccaatttatccaaagtagccaatgcatccagtaagcaaattaacaatatcagatatattgatgaggttgttggtatcaatagtttgccacccaaactgcaagaggtcgctgaggctaggttggccaatcaagaagtgagtttaaaggaattaggagaattaattccgagtggtgcaatttctaagtcaggtattaatcatcgattacgtaaactcaatgaatatgcagaaaaattgcgagcttaaactaaaaaatggtgtggattttaaaatccacaccatttttgtttgctcagattactttaaatctgaattgttttgcataattgcatcgatcagaccgtagtcaacagcttcttgggctgtgaagtaatgatcacgttccgtatcgcgattaatgttcttcaaaggctgaccagaattatctgccaaaattttgttcaattctttacgagtcttcaaaatttcagttgctgcaatttcaatttcagtttgttgtccttgagcaccaccggatggttggtgaatcaaaacttctgaatgaggcaatgcgaaacgtttgccctttgtaccagaagaagccagaacacttgccatggatgctgccattcccattacaatggtttggacatcggatttgatgaaccgcatggtatcataaatcgcgagtccagctgtaactacaccacctggtgagttaatgtaaagataaatatctttatcagaatcctgagcgtctaggaataaaagctgggcaatgattgagtttgcaacatcatcatcaattgggccagagagcatgatgattcggtcttttagtaaacgggaataaatatcataagcacgttcgccacgtgatgactgttcaataactgttggaactaagttcataacttagcaacctccctttaaaattcatcttaattttattagctcatcgctaacatgtttacagcttaccgctatggtcaaaaaaggtcaaacaatttaactcaactgaagaaaagtttttcaacgtaatcggttacgcttcaaagtctataatttagcacaaaaataagaattttgctactagtaaatattaggctaacaggtagcacgaaacatgaaatacggcagtggttactcatgaaaactgtattgataaatgagctgaaatcgaagtagattaagtatacgagggaatttttaaaaaataaattgaaaagttaatttttatacactataatcaagtcgttatagtacaacatttatttaattgagtatgtttgtgtacaaaatagaataatgtaagtgctatctttatttgaggttgataaataggtacatataaaaaaagaggttagtgctatggcaaaaagttcgcggaaacaacgtgttgcaaattatgaggcaactacaaaagagcattttaagatgtataaaaaaggcaaacactggctagtggctggcatagcggtcctaagttttggtacaggggtagttacttcgtctaatgtgcatgctgatacaaataataatgtgattgagtctagcacggaaaaaagtagttcagctagtgtgacggcgactagcgccgcaacatctgagacagcagcttcatccgcggcatcgggattcagataacagtggtatggcaaggacaggcttttcgtctgcggtaacgaatagtgtggcggcaagtgcgatgtcatccggttctgttgcatccaaaagttcaaatacaagcaatagcggcatagcttcaaatactttaggtacatcaagtatggcatctcagagttccgaggtagcaagtggtgcaccagtcagtgaaacgaatgattctagtcaagcatcagatgatagtgtgacacaaagtagcagtagattaggtgcagaaagtgcgtcatcggaagcaagtgacctcacaaatgagtcaacaggtagtgctgatacgccaacaactgataccaccatcactgcggatcagcagaaagctattaataatttaattgctttaggaaaagacaacgggattgatttgtcaaatataagtgaatctagtttgctggccgctgcttgggatactaaaacgaatacggtaaattcatactatactgatatgttaccgttacagccagattttgtactggctgctcttaaaggtatggatgaatcaaacaatttaaatgctgttcaacataccggatatgcagttaatccatacaattatactgacaaatctgcagtaacggttgatattggtcaaggaaccattacagtaaataagttaaatggcgtctcaagtacagatgaacaatatactagcttagcaaatgatgatacgattaccattagtgatttttcagagattatttcggcaatggttagcaatattacacaaactgatgaaaaaattgtttttactttaactaacgaggggttaaacctgctcactagtggtaattttagtgcgattttggcttttcagatggttagtgctgataatactgccggttatgttgaggtctttggtgtgactgcaccgatatcagtgggcgttactggtattgctgatacagcgaagaatactgaaggcattgaggagactggtacaattggaacaaatcaactttattatgcagttgagacagccttggctaacgacaatctcccacaagatgataagtggagtagcaaaactggttcaattttattgcctaatggtactttagctgttaatttaaaagaattgtcaggttttcaaattgatttgactaaaaataaattgattccaacaaactcgattccaattagtagtgaattttggacaatttctcagaatagtgatggcgactatattgcaacatttacgggtactttttataacaatccgaatcccgttaaaccaagtgaagctaataattggcattttggttatactccggtagcagctgtaggcatcagttatacaggtgtaccggcaaccgtaactgttcattatgaagatgaaaatggtgttgcagttgcaactgatgaagtgttaactcaagggactgtatatggaacctacaaagcagatgcaccaacaattccgggctatgaaattgatacggatacgccaacttctggggagattactgatcctaatcaagtagtcactattaagtatattgcagatgcacaaacgagtgatgtgcagtacgttgatgacgacaataatgatgtgcaagttggcgcattggttcctattaatggaactactaatgaaactgtcaattggaatacgagtgacagtataccgtcaggttatcaactagccgaaaatcaagtggcaaatggtacttatacttttggcgcaagtgacaacgcaaatgtggtagttcatttagttcatgtgcatacgataagtaatgaaaagaatacaactaatacggtaacttacgcggggattgatggggtgagtctcactagtaattcagtcacaattcagtggacatctgatactgacgaggtaacaaaggacgttgtttggacaagtgatgcaagtactacaacaattcaaacccctataatttctggatattctcctgataagtcacaggtagtctttacaaatgtaactgaaaaagatggagagccagctaatcaaacgcaggaagttatatataccgcaaccaatcatggttacacagtgacaccggttgatccaacaggtaagccgattacagggaccgcacctagtcaagaaacaggtgtcactggacaaccagtgacagtgccaaatgtgcccggatatcaggtaacagcaatacctctaattccgaatactgattcagaagtgaaagttgtgtatgtacctatttcaaaaaatattacacaacataaaggtaacaagccaagctcaaatttcattaagcattcttctaccaaagctaacgtagcgaaaaaacttgcagaacctagaacgcttagccaagaaaaagtggaacgaactgcaaaggttaaaagaaccggtaaaagtaatagtgaaacttctattttgcctcaaacaggtgaaaaagaaacaaatatttttgttcttataggttatgaacttcttattctacttggccttttggggattttaggaaagcaacgtaaacagcataatttaaaatagtattttttgaatcttggttctaaataataatcgctccataggtgattggaaatgtcatctatggagcgattattttatcagtgtcgttcattgttattcttgtaccacaattggtttcagttgacttattatagttagtgttaaataatagattgaattatgaacaccctttcaatggtgaaacagtgcttgttttacagaatcaatctaatttcagggtacaaaaaaatgcgccatgcgggagtcgaacccgcgtttcgagaaccggaatctcacgtgcgatccactacactaacggcgcaaattaccttttaattttactgtattaatattaaaaacacaagtttatttaatcgaggtgattagtttggcgcttcaacaaggccttcatcagcaacaaaaacaagttcaacggttagcaatgacgcaaactttacaacaatcaatccagattctgcaatacaacgttgaagaattacaaaactttttaaaccagaaggcacttgagaatccattaatcactgtgacgactaatcacgatgattatatgaatagttcacgacaaaattcttcaagccaatcagttgatgaaaattacatgaatcaaattccagatgatacacgtcagtcactttttgaatatttattggatcaagtgcatttaacgatgcgtgacacacccttacgtaatttagttttgttcttaatagaatccattgataataatggttatctaaaaatgccaatcgaagaggcgatggaaaaaactggggctaataaagtggacattgtcgatgctgttacgttgattcaacagctagatcctccaggtgttggtgcaaagaatcttcaagaatgtttgctactgcaagcagagaatgatgactgggcaccaaaggcggcagtagaaattctaagagataactttgacgaactcgccaatcgaaaatggcaggcaatagctaaagagcagaatgtgacgctggaggagattcaaactgtatttgattacgtgcgcacactgactcctaaaccgggtgctttatttaattcggaaggttcgcaatatatttttccggatctaattgtaaaaaatgaagcaggaaagttaagcatttatacatcaagagcagcaaaaccaaaagtccattttcaaaaacaatattttcagcaaatgttgcaacgtaaggacgacgaagtaacagattatgtaaaagaaaagaaacgagaatttgactggatatctcgtagtttggatcaacgagagagtactattctccgggtgggaaaagtattactggaatatcaacaagatttttttcttgaaaaaaccaaagaattgcgtccactgttattacaggatgttgcgttgaaactggggttacatgaatccacaattagtcgttcagtcaacgggaaatatttacaaactcgttttggaacttttgaattaaagtcattctttagtagtgcggttgcaaagacagatgcatctccagaagggttatcagtagattccgttaagagactgcttcagaagtttatccatgaggaaaataaaagcaaaccactgtcagatgcaaaaattgttaagaaacttgcagaaaaaaatattgaagtttcaagaagaacggtagctaaatatcgggaaagcttgaacattgcatcctcttcaacacgtaaacgttatgaatagtgttaattaaggaccgacagcgaatttttctaggctttgagttgcaatagtggctgtctcctgatataattcaatatgtaagtaaggggttatacaactgaagtagttcaggtctgtatgccatttattttgaatctgtcgggtcactaaatgacacatgtggacgtcaaacgtcccgactgggagcaatgatcatgcaaaacgagttgaaatggctggaagccatcgcaccagatatggtagatgtgtttttgaagcgtttttcggttctacggacgatcgctttaatggctcccattggcagacgaggcttatcggttcatcttaatatgagcgaacgtgggttaagaactcatactgatatgcttagacagttggacttgatacagtcgtcacccgccggaatgacattaactagggaaggccgattagttttagacggtttgaacgatatggttaatgatatgcttggtttacagcagtcagaaagagacctagcaatgttactaaacattgatcgttgttttattgtttctggagattgtgatgcccaagacagggtgtttgatagtttgggaggaattctaaacgatacacttgcaaaaatcttgccagagggtaataatgtaatagtggttatgggtggtaacacaatggcacaagttgctaaagagttttcaccagaattatccacaaaacgccaactcacatttgttcctgggcgtggtggtatgggacaatcacttgcgatgcaagctaatacagtttgtgcaattatggcggaacggacacatggtgagagccagtcaatgtatctgccagagaagttgagtgaaaaaagttaccagccgttgctagaagaaccaagtgttcagttagttcttcaattaattgagcaaagtaacgttgtgattcatggcattggacgagccgatgagatggctgagagacgagaggttgatccaaacattctccaacttctcgagcaaaagaaagcagtcggagaagcccttggttgtttttacaatcagcaaggtgacatcgtctatcgggtacctcgaattgggttacaattagagcgtatcaattcaatcgatcatgtttttgcggttgcaggtgggcatacaaaagcgcaagcaattcgttcttacatgaatttagcaccacatcagacatgtttgatgactgatgaaggtgcagcaaacttgattttaaaaaagtaatatttgtttacaaatatcactttttaaaataaaaaaattatttttttactttcctaaaggaggaaatcttagtatgactgtaaagattggtattaatggttttggacgtatcggtcgtttagctttccgtcgtatttatgaattaggcgcaaagtcaaatgatatcgaagttgtggctatcaatgatttgacaagtccagcaatgttggcacacttattgaagtatgactcaacacatggtactttccctggtgaggttagcgcaacagaagactccatcatcgttgatggcaagaaataccgtgtttacgcagaacctaaagcacaagatattccatgggttaaggatgacggtgttgactttgttcttgaatgtacaggtttctatacatcaaaggcaaaatcacaagctcatttggatgctggcgcaaaacgtgttctgatttctgctcctgctggtaacgaccttaagactgttgtttacaacgttaatgatgacgttttgactgcagatgacaagattgtttctgctggttcatgtacaacaaactgtttagcacctatggcttacttcttaaaccaagaatttggtattgaagtaggtactatgacaacaatccatgcttacacaagtacacaaatgttacttgatggcccagttcgcggtggaaacttacgtgctgctcgtgctgctggtgttaacacaattcctcattcaactggtgctgcaaaggctattggtcttgtaatcccagaattgaatggtaaattacaaggacatgcacaacgtgttggtgttgttgatggttcattgacagaattagtatctatcttaggtaagaacgttactgctgacgaagttaatgctgcaatcaagaaacatactgaaaacaacgaatcatttggttacaacgaagacgaaatcgtatctagtgatgttatcggaactacattcggttcaatctttgacccaacacaaactgaagttacaaccgctggagacaaacaattagttaaaactgttgcttggtacgacaacgaatatggcttcacttgccaaatggtacgtactttattgaagtttgctactctctaggattaaattaatctttaagtttgcagatttcaaaaccgtctaacggtttaaggcggagggaggcaaacttcctccgccttttttaatttaaaaatacatgaaatttcttaaacaggaggaattaactttggctaaattaacagtttcagatttagacgttaacgacaaaaaagttttaatgcgtgttgattttaacgtccctgtaaaagacggtgtaattggtgatgataaccgtgttgtggctgcattaccaaccatcaaatatattattgaacataatggtaaagctatcttgttctcacatcttggccgtgtaaagactgaagatgacaagaaggctttaacaatgcgtccagttgcacaacgtttgtcagatcttttgggcaaacctgtaacttttgtaccagcaactcatggcaaacaattagaagatgccattgctgatatgaaagatggcgatgttcttttgtttgaaaacactcgttttgaagatcttgacggcaagaaggaaagcggcaatgatgctaagttaggtcaatactgggcttcacttggtgacgagtttgtaaatgatgcttttggtacagctcatcgttcacatgcatccaacgttggtatttcaacagctatgaaagctgctggtaaaccagttgcagctggtttcttaatggaaaaggaaattaaattcttaggaaacgctgttgataatccaaagcatccattcgttgctattttgggtggtgctaaggtttctgacaagattggtgttattgatcacttacttgataaagctgataaagttattatcggtggtggtatgacatataccttctatgcagctaagggacttaaaattggtaattcacttgttgaaaaagacaagattgatttagcaaaacaaattttggctaaagctggtgacaagattgtgcttcctacagacaatgttgttgctgaaaagtttgataacgatgtgccaaacaaagtcgttgagggagatattcctgatggctacatggctcttgatatcggacctaaatcaatcaaggcatttgaagatgttttgaaagatgctaaaacagttgtttggaatggcccaatgggtgtattcgaaatgagtaactatgctaaaggaactcttgaagttggtaagttcttaggcacattatctgacgcaactacaattgttggtggtggtgattcaactgctgctgttaaacaacttggtgttggcgacaagttaactcatatttctactggtggtggtgcttcccttgagtaccttgaaggaaaaacattaccaggaattgcagctatttcagataaataggcaaatagtgagcttgaaaaccaattcaggctctttgctgtgaaatgactgagatttgttatcaatgaaaggaagtattattgtgcgtacaccaattattgctggaaactggaaaatgaataagaaccctaaggaaacaaccgaatttgtcaacgctgttaaagcagatttacctgcaagcgacaaagttgaatcagttatcggtgctcctgcagttgatttacaagctttattagatgccgctaaaggctctaacctaaaagttgctgctgaaaacagttattttgaagacgaaggtgcttttactggtgagacttcacctaaagttctttctgaaatgggcgttgattatgtaattatcggccattcagaacgtcgtcaatatttcaaggaaactgacgaagacatcaacaaaaaagctaaagcaatctttgctaacaacatgttaccaatcatttgctgtggtgaaactttagaacaacgtgaagctggccaaacaaatgactgggtttcaggccaaatcacaaacgctcttaagggcttatctgcagaccaagtggcatcacttgtaattgcttacgaaccaatctgggctattggaactggtaaaacagcttcaagtgatcaagcacaagaagtttgtcacgtacttcgtgaaactgttgctaagttatatgaccaaacaaccgcttctaaagttcgtatccaatacggtggtagtgtaaaacctgctaacgtgaaggaattaatgggcaaagaagacatcgatggtggattagtcggtggtgcaagtctagttcctgactcattcttggaattagttaactttaatgcttaattttagagcagttttgtaatacaattgatctgtaacagaatttactaaatttagtgaggagaaattacaatatgtcacttattactgatatttatgcacgtcaggttttagattcacgtggtaacccaactgttgaagttgaattatatacagaagatggcggctttggccgtggaatcgttccttctggtgcttcaactggtgaacatgaagctgttgaacttcgtgatggcgacaagagcaagttcatgggccaaggcgtaaccaaggctgtggaaaatgttaacaagttaattgctaaggaaatcgttggttatgaagtaactgaccaattagcaattgaccaagctatgatcaagcttgatggtacaccaaacaaggctaaattgggtgctaacgcaatccttggtgtttctttggctgctgcacgtgctgctgctgatgaactccaaattcctttgtataactacttaggtggattcaatgcacacgttttaccaacaccaatgttgaacgttatcaacggtggaaaacatgcaaacaatgatgttgacttccaagaattcatgatcatgcctgttggtgcaccaacaattacagaagcaattcgttggtcatcagaaacattccacaacttaaagaacttgttaaacgaacaaggatactctacagctgttggtgatgaaggtggatttgctcctgacttgaagaacaatgaggaaccattcgaaatccttgttgaagctatcaagcgtgctggttacaaaccaggtaaggatattgcaattgcctttgactgtgctgcatcagaattctacaatactgaaacaaagaagtatgacttaaagggtgacggcaagtcatatactgcttcagaatttgttgacttacttgacagcattgttgacaaatacccagttgtttccatcgaagatcctttggatgaaaacgaatgggaagattggcaaatggctactgaaaaacttggtaagaaagttcagatcgttggtgatgacttgttcgttacaaacactgactaccttgctaagggaatcaagatgggcgttggtaatgctatcttgatcaagttgaaccaaattggtacattaacagaaactgttaatgctattgaaatggctaaagaagctggctatacagcaatcgtttcacatcgttctggtgaaacagaagatacaacaattgctgacttagttgttgctttgaacgctggtcagatcaagactggttcaatgagccgtactgagcgtattgctaagtacaaccaattgatgcgtattgaagatcaattaggtgaagttgcacaatacaagggtatccatgcattttacaacttaagcgaacaagcacgtaacgcaattacaaacaagtaattctacgtttaccaactagttcattaagagtcattcggtttataccgaatggctcttttttgggtttgctaataagtaaaaaagtgtaaaatagaataaaaagccgtgaagaaggtaaacaatatgcaggagaacttatctttatttgattttgacgaacagcaggaggcggtactgatgcctggccatgatggtccatttcagtttcatgcaaaagctatttttccttttttaagtgatagcgacattttgcaatttgtgacgacgcataatggtaaacaaatcggtatttttgaaacgattacaaaaacttttcctgtatacgaatgcttgtaccaaaatgagcttcttatggttgctcaagcgccattaggggcaccagcagcgacacaatttttagatttcttaatttattttggcgtacggcaagttatcagcgtcggtagttgtggggttctagtagatataccagaaaataaatttctggtttcaacggtggcgttacgcgacgaagggacttcttttcactacgcacctaagagcgacttcattaaattgaatcaatccgttatcagcactatcgagcagagtttaaaagagcaccgcttaaactttcatgaagtacaaacgtggacgacagacggattctttcgggaaacgcccaaagttattcaaaaacgaaaggcacaaggttgtgaagttgtagaaatggagtgtgcggcattggcggcatgtgcacaatttcgaaaagtagactttggtcaaattttctttacagccgattctttagcaaatttgaaagcttataatgaacgaagttggggtgcccagtcgcaagaaaagggcctaacacttgccgccgaattagtacaagcactttaaattacagggaacggagcaatcatatggtagagaactacatattatcaattgatgagggaaccaccagcacgcgggcgataatctttgatcatcaaggtcaaaaggtggttgatgctcaacgtgaaatcccacaaaactttcctaatcctgggtgggttgaacatgatgcgaacgaaatttgggacgctgtgttatcaacgattgccgacgccctgattaaatcacgaattcggccttcgcaaattaaaggaattggaattactaaccagcgggaaaccacagtcatttgggataagaaaacagggttgccaatttataatgcgatcgtttggcaatcacggcaaacggcagatattgccaatgaattgattttggctggttatcagcaagaaattcatcaaaaaacaggtttaattgtggatgcatatttttcagctaccaaaattcgctggattcttgatcatgtacctaatgctcagaaacgagcagaaaatggcgagttgctatttggcaccatcgacacttggctggtttggaaattaactggtggcgaggttcatgtgactgattattccaacgccagccggacaatgctattcaatattcacgacttaaagtgggattcagatattttgaaactacttaatattccacgggtgctcttacccaacgtaaaatcaaactcagaaatttatgggtacacaaaagattatcatttttttggtagcgaagtgccaatttctggtatggcaggagatcagcaggcagctttatttgggcaaatggcgtttgaacctggcatggtaaaaaatacgtacggtaccggtgcatttgtggtgatgaataccggcaaaaagcctcagttgtctgatcataatttactggccactattgcttatggcattaataatcaaatttattatgcacttgagggcagtatatttgtggccgggtctgctattcagtggctgcgtgacggtatgcaattactcaagaattctgccgattctgaacaagcggccaacgcatctactgatcgaaatgaaatttatgtggtgcccgcatttaccggacttggggctccgtattgggattcagtgacgcgtggagccgtgtttgggatcacccgtggaaccacgaaaaatgattttataaaggcaactttacagtcgcttgcttatcaaacgcgtgatgttgtggatacgatgaagcacgatgctgacgttaagatacctatgcttaaagttgatggtggggcttcacataacaactatctaatgcgatttcaagcggatattttaggaattgaaattgaccgagcggcggatttggaaacgacggctttaggagcggcttttttagcaggactaggtgttgggttttggaaaaatattgaagatatcaaaagcatttataaaacgggccaaatctttttgcctgatatgaatgaagaggaacgccagaacctttattccggttggcaagaggctgtgcaagccgcacaattattcaggcatcaaccatatcgaaaaaagtgaaacgaaagacagtggcaaaaaggtggttggaccgtgcgttagtctggcgactactcagtatttaggaagcttattagtaaaacccactaataagcttgtatctttcggacgatgaccattcttgtggcttcaaatcaagccgcaagaactggctgcaaaaaatctgttttacttacattttagtaataatattctggaaatataaagagaccatacccaaaatatagtttttgcctggtctttttttcgtgaccgtattttggtgatatactgaataagaagagaaaagaattgagatgaagatatgcagtggcaaggttccttagataataaaaaaagttcaccagatgatacaaggttggtgtcaattctaaagggttgtttgactggtgctttggccggtttagtggtgagcgtgtttcgcttggcgattgtacaaagcttaaaattagtgacgattgtttatgatcaaatttcccacaattggactatattgccaatttggctactggtcgtgttgggtttggctgttgtagtgggatatttaggaaaacagtttccagaaataaaaggatcggggatcccccaagttgaaggccaattgtctggaaatttggagtatccctggtggtcaatcctgtggcgtaaatttatcggtggtattctggcaattgggcctggcttatttcttggtcgtgaaggaccctcaattcagttaggagcaaccattggtcagggatacgctgaattgacacatgaatcagaagttaatcgacgcgtatttattgcaagtggagcggcagcaggtctgtctgcggcatttaatgcacccattgcgagcacgttgtttgttctagaggaagtttatcataatttttcaccgttaatttggacaactgctctagcaagtgcaatcgcttctagctttgtttcaaccgtattttttggtttaactccagttttacatattgtttataccaaaacattgccgctaacgatgtatcctcatttgttgtttcttgggatttttttgggagtaatgggattcgtctaccagcgtgttttattgaagatgggggattggtacgaatatcttattaaattaccaaaatggttgtttggcatggtgccctttattttagtgattccaattggtttattggtcccaaatttattaggcgggggcaatagtattattttgaatattgctgggcatacacccggacttctaattttgcttggtatttttattttacgctttgttttctccatgatttcttatggatctggtttgcctggaggaattttcttgcctatcctgtctttaggagcaattctgggggcaatttatggtcaaaccatgatttggttaggtatttttccagcgagttatctcacaaactttattattattgcaatggctggttattttgccggaattggtaaggcgccatttacggccatcctattgataactgaaatggttggtacccttcatcatttgatgccactggctgtcgtttcgatcacggcatatgtagtggttgatttattaggtggtgcaccaatttatgaatctttgctgcataagattgtaaaaccgagtgttcctaatgctagggggaaactggatcgggtagaatttccagtttttgcagggtcatacatggtaggccatcaagtccgtgattttcagtggcctcaaaatagtttgttgattgcgattcgacgtggagaacgggaagttattcctcatggtgataccttgctgattgcgggcgatactttggttgttaccacgaatcatcgtaatcgcggcaatcttttacatttattacaccagcttccgatgcaaacgaagtagtggtttgttagagaaagctagtggtaggactggaaaaaaaaggtaaactatgataaattatagaggatatactacaagtttaggtaggaggttgctacttgtataatttattaatgacaatattattggttgtttccgttttgattatctttgcggtaatgatgcaaccagcaaaaacggataatgcgttatcatctcttacaggtggtgcggacgatctttttgctcagtcaaaaccacgtggattcgaagcatttatgcaaaaagtaacgttagtattggggattattttctttgcggttgcgatcgcaatggtttacgtttcatcacactaacggttaagcctcctgtgtttcgcaggaggcttttaattaaggtttaaaacaatataaaatttgaggtagagtatggaaacaaataaactacaagcttcagttagtagctttttaaatcaacatccaaaagaaagttttactgccgaagaaatttttcaacaattaaatttggaaggtgccagcgtttttaatattttagtaaaagagttggcagtaatggaacgtgcaaatcgggttcacattacggagaaaggtaaatttactttgcctattcagtctaatcaacaattggtgcatggtgtttttcatgccaacgatcgtggctttggtttcgtagctgttgatccggaagttcctgatgtttatatcagcgaggatcatacggcgtttgcgttaaatcaagacgaagttgatgttcgaattatccgagcagctaaaccaggggatgacaagggcccagaaggtgttgttaccaaggttacagacagacactttacgcaggcggttggcgtttttaaatcggttcctgatcctgaaaatggtgttattggggaaattgagttaaaggacaagaagctttcttcttatcattttgatgtgcttgcttctgggatcaaacctcaggatggggctgtgattacggcagaagtaacccagtatcccaatttaaaacatcctaaattaatggcgggtttagcaattgagaccattggttttaaggatgatcctggtgttgatattctccaggtaatctaccaacacgaggttccttatgaatttccagatgatgttaaagaagagattaaatcaattcctgacacagttacagatgccgaaaagattggtcgtaaggacttaacttcggaaacagttgtgactattgatggtgacgactcgaaagattttgatgatgcagttggtgtgtacaagatggccaatgggcattaccatttgagcgttaacattgctgatgtgagccattacgttaaagaaggttcaccactagaccatgaagcttatcgccggagtaccagtgtgtacttgactgaccgggtggtaccaatgctgcctagaaagttgtcaaacggtatctgttccttgaatccaaatgtggaacgtttggcgatgacctgtgaaatggaaatggatgaagaaggcaaggttgtcagtcacaagatttatccaagtgttattaagtctgatgccagaatgacttattcggatgttaacaaaatccttgaggcacatgatgaaaaaacaagggcaaagtatgccgatttggttccaatgtttgaaacaatgggcgaattgcacaagctcttattgaagcggcgtaaacgtcgtggagccattgaatttgacgataatgaagcagaaattatcgttgatgaaacaggtcatccaattgatattaaagtgcgggttcgtggcacttcagagcggatgatcgaatcctttatgttggctgccaacgaaacagttgcgcaacactactctgaattaaaggtaccattcttatatcgtgtccatgaaacaccagatagtgagagaatgttgagtttcttcgaattcttaacaaactttggttattcagtaaaaggcagttctaaaaacattaaaccaaagatgttacaaagtgtcttaaaacaagtttcgggtagtaaagaagaaacaatgatttcagtcatgatgttgcggagtatgaaacaagccaaatattctgaagattcactgggtcattttggattagctgctcagtattacacgcatttcacctcaccaatccgtcgttatccagatatgtttgttcaccgactcattcggcactatgctgaagatggcgttggtgaagaatctaaggcgcagtatgtggatcggattcctgaaattgcagaacatacttcaaaattagaacgtcgcggtattgacacagaacgtgatgttgacggcatgaagaaagctgaatatatgggcgaccatgtgggtgaagaattcaaagcggttgtgagttcagttatgaagttcggtctgtttgtggaattggataatacagttgaaggcctagttcatattagtcaaatgaaagatgactattacgagtatgtagaaaaccaacttgcattggttggccgaaacacacatcgaacttatcagattggtcaagaaattgaagtcaaactgattcgagtagacaaggatcaaagtgaagttgattttgcattgttgcatcctgaaaaaacgccaacgagtgaaattcagttaccaccacgtcaatttaggaatagtgggaattttaaatctggtaatcgacagggcaatcataataagaactttcataaaaaatcatcaagcacttacaaaaataattctgccaagaaatttaatgaaaataattcacacaaggctacgtcaacttcaaaaacttacaatcgtaaaaagtaggagtgatgtaaatggcaaaggctaaaaagaagaagcaagattcagccttagcacaaaacaaaaaggcgcgtcatgactatcttatttctcagacttatgaggcgggaatggtcctgacgggaaccgaaatcaaatcggttcgcgctagtcggattaacctgaaagatggttatgtccaaattcgaaatggtgaagcaatcctgatgaatattcacattagtgagtatacagaaggtaatcagtttaatcatgatccgttacgtaatcgcaagttacttttacacaagaaacaaatcactgagttagctgaacaaactcaaaataagggaatcacaatagttcctttaaaagtttatatcaaacatgggtttgccaaagttttaatcggggtagctaaaggtaaacatgaatacgataagcgagaaacattgaaacgacgcgaccaagaacgtgaaattgctaaagctgtgaaacgataccgttaaaaaggactaggaaaagtattttcccagcccttttttggtatccattatttttgtgtttctttttttctttgtgctcttgcaattgatggcataatcaagcctaatgccaaaagaattcctggagtgacaatgttcataactaattcttgccagtaggtgaatgaacttggtgacacgtcctgaggtaaaattccaaacgttgcggcgacaaacgtaatgatgaagcaccataaggccacgagataggcggtacgatcgtttttgataaacacgtagtcagagtgaaatttttgcgaattctttctgacttgcatgaaagcaaagaagatccaacaagtcacatagggtgaaacaattccgttcagatttagcaaccaattgaagatttcattcatgtccggtaagaagacgcccataagtagaattccaccagataattcagaagtcaaaaggtaaccattaataggtcggccatttcgattaagtttcaatagttgttttggcatgaagcgtttgccggtatctaagattagcatccgggtcattgcgtctagcaataaggctagaagagcaaacatgtaaagtagttgggcaattgagaacaaaaacatcatggagtgccctaagccaatgtggcgcccaacaaaatcaaacgcatagtaacttccgttcatctttaaatctgctggcaaatggtgaccgttgaagaaaacgcctagtgaaaacgaaccaaagatggttaggaaaccagccatcacagtcagcataataattgactttggaaagtctcgttttggatggcgcatgcgggtaacatagggtgcaaccagctctgaaccgcttgtggcgtatattaacaaacctaatgttgaaaaaaagtgcaaatcaattttcggtgtaaaagtcgatacatgtaatggcgcggaagcaatgtgttcgccgtgggtcagattaaccaccgttaaaacgacaaaaagaactgtcataataaacattgcgccaccgcctaaagcatttaaaacctgtaacgagtttttgatgtgattctgaagaaaaataaaaatgataaaaactaaaaaggtgagcaaagcaaacatcgcattagacatatgttgttccattgcgttactgccattgattaaccagccaaaagcgacaaccactgaattggcggtatcgaccacgtacggaattgaggccgcccaataagtccatgccgtgagataacctagagtgtcaccgctagtttcacgtacccaagagctaaggccaccaccagatttactaaaggttgaacctaattgaccaaccatcagtccgtacgggatcacatataaagcaaataaaaagacccatgttgtgatgacaccaagaccctggtttttaaagttataaataatatcatcaaagccgatcacattgacgaaagccataagtcctaagactggccaactaatatattttgtatttttcatattccaaattccattctcaaaaatcatttaattttagcatagtttaaatccaaaacgctataaaaaaatgagacaaaaataaatttttttgcctcaatcttctaaagggtgattcagatttaatttttgaagattaaacttgcttttttagatgatagtaatggtgaccagcaaccacttggacgcgttcatttttaaagccaacccgttgataaagttttgcggcctcaggattttcaaaatctaccagtaaaccaattttgtgcgtgtggacttgtttgccaattgtcggtaaataattgagcaattgggtgccaatacctttgccacggtgcgtttcagcaacacacaaggagttcaggtaccattcgtctttatctgcctcagcatctgaaaagatgacgactgtttttggaatttgtaattcttcatagtaacgattaaaaacgtcaaatagttgctgttcatgtttgcctacgtagccaaacatgacaccaagaacctcatcatgatctttcgcaacaattaagttggccagctcaccttggtattccggggaagcaaatgtcttttcaaaaagctgggttagttttgaattcgataattcgtgaagagcaggcaattccatttcttctaggatgactttaatcaagtcaacaatttgtggaacatcttttgtttgtgccgcttggatttgcaagttttttcctccgtttattcagtaagtttatttttattctttttatgttcatgaatgttattaaaactggtttcaccattagataactgccatccagggatggatgctgtctttttgacaccacttttggaatcttttttagtccaatgatcaagaattgcggctaaacaaatacaaacaggctctgtggcctgcgaagtgataagtagctcattgtaaccagcaccatataaaatgacaggagtaacggtcataatgcgtttgtggacactgtagacatgatgtgaacccgttcgcaaactacctgtgatgaaccattttagtttattgatatacaagaattcgtgaaaaaggccaaaagttttagagatcgaaccgattttattaccgttaaaaaagatatcaaacttagggaaaattcccactgaggtctgtttgatttccgctaagaggtcaccttgaatatcgtagacagacagggcatcatggcgaattccccattttccaaccagcagatagcaggaattattgtgatcgtcacgaacaacggtagcgcccttattggttgcatcttggttccttacataaagcttacgcataagtatacccccataacaaggccgttattggcggttgcttttgagttgttccaaaatggctttaccaaccccgttttcgttatttgaaacggttaaatgattcgcaatttttttgatttccgggattgcgttgcccattgcataactggtatcggcaattcttagcattgatgcatcatttaaattatcaccaattgccattacctgagacataggaatgtttaattcgtcagcataatgttgcaaggcaattcctttttgagcacggatattattgatttcaatattagttcgagaagatgaagtaattgcaacttccacttttttattaattttatctgaaactggctttaattttttcggaccttcatttgcaaatgcgataattttaagaattcgaacgttgtgatcatcaattagttcctgataatcatccacgtatgaaatatccatcaattcaacccgagcagaagccaatgagacggccaatttaaaaggcgtgtcaggatttagattatttaaaagttgagccaagttttgaatgtgcatggtacgactattagaaaccactccgtcggctgttacaacttcataatataaattagccaaatttagttcacgcataatttgagtaactgtagctcggtgaaggggaaccatatctaaagccttaccatcaacatcataaactgcggctccatttaaggtaatcataggaacttgaataccaaacttttcgattaaaggtttggcctcagaaagctggcgaccagtggcgacgataaagtgaacgccctcactttgtgcttgtttgattgctgcagcattttcttctgaaacttccattttttcgttgagcaatgtgccatccatgtcagaagcaattattgaaatcatattttcacgtccttgttaggttttatatcttcagtttaacatgaacccttgtttttttttagtcataactcattggatttaatgttattaaatcaattatggctatgctagaatatggaggtgaggtgtaaaaatgaaaacgtttattcataatgattggcaagaggtcttaggacctgaatttgaaaaggcttattataaagatttgcatgattttttaaaaacagaatatcgcacacagctcattcatcctgatatgtttcatatttttgaagcatttgaatggacaccttttaatcaggttaaggttgttatcttagggcaagatccctatcatgaacctcatcaagcacatggcttgagtttttcagttttacctggtgtgcgaattccaccttccttacaaaacatttataaagaattacaagaagatttgggcattaagccagtttcacatggttatttggagaaatgggccaaacaaggtgtgttaatgctgaatacggtattaacagtccgcaatgggcaggcattttcacataaaggtaaaggctgggagcaactaacggatgttgcgattcaaaagctttcggaacgtgaaatgccagttgtatttatcttgtggggaaaggcggctcaagcaaaaatttccttaattgatacgaaaagaaacattattattaaatctgcccatccaagtccattttctgcttaccacggtttttttggttctcatcctttttcaaaaacgaacgcggctttaaaagctttaggtgaagagccaattgactggcagttaccagagcatgtggaactttcagaggacgcaaaacataattatcagcaaacgaggtagctcatgtttaagatcaaaacaaatgatgcagaacagactgaaaaaattggtgctcaacttgcccccattcttgaacccaacgatgtgcttttactggatggcgatttaggtgcgggtaaaacgacttttacaaagggattagcaaaaggactcggaattaagcgctatgtaaaaagtcccacatttacgattattcatgaatatcacgaaggacggatgccactttatcatatggatgtttatcgccttgaagatggtggtggcgatgaccttggttgggatgaatatttctttggtggcggtgtttctgtgattgaatggtctcaatatattcgtgattatttaccagatgattacttaaaactaaaaattgctcgtaatgacgacgatgatgatcaacgaattttaacttttgagcctcaaggccagcattatgaagaattggtagctcaactgaaagaggttcttgaatgagtgaagaagtgaccattgttgaagccacccgagaagatgcagatgaagtattgaaattattgaaacaactagatcaagaaacggaaacatttacggttgaagatgatttaaacaaattgacagcagcgactgaagaaaagcaacttgaactgattcaacagagtcgtgaaagcttgattctgttggcaaaatatcagggacatgcaattgggttagcttcagtaatgaaggacgaaactactgaattaggagaagtaggcgttgccgtattgaagtcattttggaatcaagggttgggaaccgcgctagttgaagaaaccattacttggggtgagtcgtttagctggttaccaggattaatgttaacagttcaggaacgtaatcagggagcttatcacatttatcgaaaactaggtttcaaagacattcagcgtaacaaaataggattccatgataaaaatggaatcccctatgcaacagtagatatgcagcttttatttagttaatcatccgcacaaacggttttaactgttctgcaccaaaattatttgcttcatataacaaaatattggcgcaggctagactatcgtctaacgcattgtgatgatgattgagctcgatgcccaagtgggtgcaaactgtgtctaatttatggctctcaaattccgggaaaaatttacgactagagcgcaccgtatccaaagttaggtagtgagtacgctgaagttcataatgttcaagacaactttttaaaacaccgttatcaaatggcgcgttatgagccacaatcagttgattggtctgaaaaaagggattaataacctgccaaatttctggaaaactcggtgcatcaacgacatcttcttcatgaatcccatgaatttgaacgtttcgccaattaaactcagtatctggtttaataagggaataaaattcatcggcaacctggttattgcgcacaattgttagtgctaaggaacaggcactataccgtttgggagaggctgtttcaaaatccatggcaacaaaattcataacaaaaagtcctttcgaaaatgattaatttagaagtagttagaaaaactggtcatgagtaataattagcaccaagtatttctagtggttttattataatctgaagcaatctataaagatagtattaactctgtgtgagtttattaaagatatgataggggatcgcaatatgaaaaaaattggagtacttggtctaggtaatattgctcaaaaggcttatttgccggtcatcacgtcgctacaggatacttatgaatggcatttttgcactcgcaacgcagataaaagacaaaaattgatgcggcagtatgggataactcatggtgaaggaaatgtggaagaattaattgctcaaaaaccagctgcagtatttgttcatacgccaacagctacccattatcaaattatcaaagctttgttagagaacaatattaacgtgtacgtggacaaaccagtttcagaaaactttgaagaggttgaggaactatatcgactggcaaaagagcgtcaactgattttaacctgtgggtttaatcgtcggtttgtgccaatgaatcagaaattaaaggaattgtctaataagcaggtgattcgtggtacaaaaattcgtgaaaatggcgcacaagaaacaaagtttgcaatttatgatttgctaattcatgtggttgatacggttaattttctgttagatgaaccaattgaaagccaagaaactactctatttaccgaaaatagtaatttacatcaagccattgtgtcactaaaaaccaaacatagcttagcaactgccgagattaatttaatcggtggcgtaaatgaggaaacaacctcacttgaaactaagagaggactagccacagtcgagaattgtcagaactatacgttgaaaacgccgcaagggcaacaaaaaatagcctctccagattggcaaccaactttggtcacaagaggtttcgatccattgattcgtcaattcttggccgcaatagatggtcagcaagccaatccggtatcaccggaatctgcaatcgagagtcatcgtatttgtcgggatgctgttcgtcaatttgaagtgttaaaatagaatttaatcgtaaattgaaaggactcgtatgattttgcaaacgataactgaaacatttccagacattcaaatattagaacgtgagccactgtcaaagtatacaaatactaaaacgggtggaccagccgattacttagctttccccaaaactgtagagcaggtaagtcaattattagactgggccaatcaacaggaaatgccattgacagttgtgggaaatgcaagtaatttaattgtccgagatggcggaattcgtggtttgacggtcatccttacaaaaatgaaagaaattcaggtgactggaaaccaggtcgttgccgaagccggggctgcgctgattcagaccactgaagttgcctaccaagctggcctaacaggaatagagtttgctgcaggaattccaggtagcgtcggtggcgctgttttcatgaacgctggggcttatggtggcgaaattagtgaagtcgttagtgaggctaaaattttgacacgtcaaggtcaaatccgaacgctcactaatcatgaattggattttggttatcgtcacagtagtattcaagactatgatgatattgtgttatcggcaacgtttaatttgaaatctggggatgcagaaaagattaggtcacggatggatgaattaaatcgattgagagcctctaaacagccactggagtatccttcctgtgggagtgtgtttaaacgaccaacaggctattttaccggtaaattgattcatgaatctggccttcaaggttttcagattggtggtgcacaagtttcccagaaacatgcaggatttattattaatgtgggtggggcaactgccacggactatctcaatgttattcatcatgttcaaaataccgtttttgaaaagtttggggttcatttacaaacagaagtacgcattatcggtgaaaaataaagtcatgaaaattaagtggcagagattatcttatttttgatgtttcagaaataatattcgggaaacacaacgaaaccgcaacaaaagcgtaatttttgttgcggtttttttgctttttattgccaaatctcatattttccactcttttaatttgtgtttcgaattacgcggagaaccacatagatgatactttgaagtaaggtcattaaaaatacgaaagccaacatttgtaatgaccacatgttaaagattggttttaaaacccattcaggactaatcaagaggtagatggtatgtaaacgtaaaaaacggccaatgaaaatgccaatggaagacagagttgtaaagacgcctacaattcccatttcgacgatccgatgatgaatgtggtaacgtttgacaattgatctggtgacctgagtcatgctccacatgccaagcatgacgctggggatgacagctagtaacatataaatataataaatccacattgaaattgataaacgaattaagcctgtatcagcgtaaggatgcaacaaactgagatggaaaagatccgttaataggtaaggcgcatttggataaaatagtaaccacaataaaataactaaccaaaaaacgagtgaattttttggtcgatttgaaccaatgtgaaaggcaaattcaattggtatatacgctaaaaaagtgttgagtagcaaaaaatgatatggtggatgtacaaaaaaagcaatgtatagtaaacccaagccataacaaagtcgaattatccattttgtctttgtagtcatagtgttttcctcgctaggtttattgtagcagatggaaagaatattttgctataaaatgaccggattctgaagtttttcttaagggtctctgtgctataattatttttgtattggtttggaggaaaaaacaaatgaattttgcttgggatcgactgattactttacataactttatgaacctaatcgatatcctcgtggtttggtttgtgatttatgaattaatcatgttgttgaggggaacaaaagccgttcaactttttcgagggataattgtcattatcttgatcaaagtggtgagtgtccttcttggattaagcaccgtttcatggattatggatcaagttatcaactggggtgtaattgccatggttgtcatatttcagcctgaaattcggcgtggactggaacacttgggccgtgggtctatgttcgtcaaaaacaaaactcaaaatgaagctgaaaaacatatgattgcagggcttgataaggccattcaatatatgtcaaagcggcgtattggggcactaatcaccatccaaatggatacggggttagaggattatattgaaactgggattgcgctagacgccgatattactggtgaactactaatcaatatatttattcctaataccccacttcatgatggggcagttattattaaggataataagatagctgttgcggctgcctatcttcctttatcacaaagtacgatgattcctaaagaattgggcacacgacaccgagcggcagttggtattagtgaagttacggatgccgttacggttgtggtttctgaagaaactggtgaaatttctattacaaaagataatgaattattgcgtaatatgacacaagaagattatctgcgttacttccgcgatcagtttctcagtgatgaggtaccagaaaatcacaatgttattcaagacttcttggagggcattacttccttcttcaaagggggtccgaaaaaatgaaaaaattttggacagaacgttgggtttaccgatttttggcgttagttttagcagttcttctctttttttacgtgaaatcagatcgaatgaattcaggcaacgtttctactagtggcggttccagtgacacagcgctgatggcaaataaatcaaaaacattaacggttccccttgaattggacgtaaacagtagtaagtacttggttagcgggtatccctcaaaagtaaaaattaaaattactgggccaagtgcattggtcacaaccactactaacacacagaattttaaggcatatgtctctcttcgaaaactggggcttggtgagcataaggttcggattaaagaagaaggtttgaacaaagaactttcatacagttttgaacctgaaacgattaaggtgacaatcgccaatcgacgaacgaagacatttgcaattcagccagaaattaatcaagacgcgattgcaaaagggtatgaaagcaaggctgccattttacgttcccagacagtttcggcaacaggttcggtttcagaaatcaatcgaattacacaagttgtggctaaggttaatttacccaacaacacaaaacaggatgtgacaagtcaagtgttgttacaggcactggataattctggcgatacagtaaatgttatcctaagtccacaaacagtcagtgtgaccgtgcctgtcgaaaaatcgacgagttcatcaagcagtggatcagatgaagagtcgtctagtactgaggctgataataaacggactaagagttcatcaagttcgtcccaagaaactagttcggcgagttcaacttcatcaagtagtacaagttcaaaaagtaattaaattcaaaagttaggaatgaggaaaattatggcattaaaatattttggaactgatggtgtacgaggaatagcaaatgaaagcttaacgcctgaaatggcctttcaattaggaagaacgggaggctatgttttaacccagcacgctgaaaataaaaacgaacaaccacgggtattggtttcccgtgatacacgaatttcaggacaattacttgaaacagctttgatttccggtctcttatcagtcggaattgaagttttaaatatgggggttgtgaccactcctggggtggcttacttagttcgaaaacaagaagccgatgcgggtgttatgatcacagcttcacataatcctgtacaggataatggaatcaagttctttggtgcagatggttacaaactttctgatgaactagagggtgaaattgaggttctcttggacaaagaaaccgatgacttaccacgtccttctgctgaaggcttaggaactgaaaatgattatccagaaggcgctttgaagtatacccaatttctagaacaaacgatcccagatgatttggacggtttgcacatttgtgtagattctgctaatggtgccactagtggttttgtttctcaaatttttgccgatcttggtgcagattttgataccatggccacttcgccgaatggcttgaatattaatgccaatgtgggttctactcatccggagcaattacaaaaatttgttgtcgaaaaaggcgctgatttaggggtcgctttcgatggtgatggtgatcggtgtgtcgcagtagatgaattgggaaatatcgttgatggcgacaaaatcatgtacatttgtggaaaatatctcagcaaacgtggtcgtctcaagaaagacacagtggtcacaactgttatgagtaatttaggcctatacaaggcacttgaagcaaatggtcttcactccgtgcaaacacaagttggtgaccgttatgtggttgaagaaatgttaaaaaatggctataacgttggtggtgaacaatctggtcacgttgttttccttgattttaatacaactggtgacgggatgctgactgccttacagttaatgaatatcgttaaacagactggcaaaaagttatctgagttagcagctgaagttaaaacttatccacagaaattagttaatgtaaaagtccaagacaaaaaggccgctttgaataatgaaaaagttcaggcaatcatcaaaacggtcgaaaaagaaatgaatggcgaaggtcgtgtgttagttcgcccaagtgggaccgaggacctattacgagtaatggccgaagcttctaccaaggaagaagtttctgcatatgttgatcgcattgtagatgtcgtgcgtgaagaagttggtgcttagaattaaaaaatgagtagttattgttatcgagaagtttaaaaacgataacagtaactatttttttgtcccaatactaaaatagaccaatctagagaactaaataaaccaaatatgattaaaacagttgacaatccttttaattagcgataaatttatagatgtttcaagcgtaccaattttaattatctatatataccaattataacttatttgtaaaggatgtcagctatgtgtggaattgtcggtgtaacaggaagaacagatacagtcgaaattttgatttctggattagaaaaattggagtaccgaggctatgattctgccggaatttatgtaaatactgcagaaaaacaagctcatttagttaaggcaagaggaaaaattgcagatttgaaacttaaattaacccctgagattaagggaactgctggaattggtcatacaagatgggcaacaaacggagtgccaagtatcgaaaatgcgcatccacagttttctgcagatgatcgtttttatttagttcataatggtgtgattgaaaattatgaggaattaaaagcacagtatttaagtgatgttgagtttgtaagtcaaacagatactgaagtggttgtgcaacttgttgatcactttgtcgttcaagaaaacatgacaacaaaacaggcgtttaaaaaaacgttgagtttattgaagggttcttcttacgctttcttattaatggaccatgaagaaccagataccctgtatgttgcaaaaaacaaaagtcccttgttaattggactaggtgatgaatttaatgttgtttgcagcgatgcactcgctatgttgaatgtcaccaaagactttttggaattacacgatggggaaatggtggttgttacgccacaggcagttgaaattacggatcaaactgggaagcaagtaaaacgggactctttccacgttgatttggatccaaaggaaacggatcggggtgcctatccttattacatgttgaaagaaatcgatgaacagcctgcagttttacatcgaattcaaaaagcatatctagagtctggcgacaaacctgcgatttctcccgatttattggaagccatgaaacaagctgatcgtttgtacatcgtgggcgcaggaacaagttaccacgctggcctggttggcaaacaattatttgaaaagttgactgagattcctaccgaggtggttttggcctctgagtttgcttatgcagatccaatgctttccaaacatccatttttcattttcttaactcaaagcggagaaacagcagatagtaggcaagttttggttcgcgtcaatgaagagtggcacgcaccaagtttaacgattaccaatgttgaaaactcaacgttatacagagaagccacctatcaattgttgttgaacgcaggtccagaaattgctgtagcttcaacgaaagcatatactgctcaaattgctgtggaagccgttgtggctaaagcgcttggaatggcacgtggtgttgaggttgcgaagaactttgacttgcagcgagaattgagtttggctgcaaatgcaattcaagccattgtagacgaaaaagcgaaaatcaaagagattgcccatgaagatttggctaaaacccgcaatgcgttttatattggtcgtggtgtggattactttgttgctttagaagctgcattgaagctcaaagaaatttcatatattcaggctgagggctttgcttcaggtgagttaaaacacggcacaattgcgttaattgaagatcaaacgccagttatcgcgcttattacgcaggggaaaacggctagtcacacacgaagtaatatccaagaggtgaagtcgcgtggggctcaagtgttggcaattgtttccgaagaattagccaaacctgatgataaaatcgtgatcccaacaatttctgaattactcatgccattaataagtgtgattcccgctcaattgttagcatactatgccagcctagagcgcggatacaatgttgatcagccaagaaatttagccaaaagtgtcacagtagaataaagaagaatgaagtgccttaccatttccatcgtttggtaagactctttttttgtggaaaagtctttcttttaaatgttaagttttagttacaatcaatatatgagccttgaagaagcttgatttgtagggatttagcaaatgtcggtaatttttggatgtttcaatacaattaaaggcattaatttttccggatttaagttatatacttatatttaagatgactaagatacgggggaagcagtatgcataaacgatggataacatttgtttcattcttaatattactttcggcggttgctgtttttagcacacatacaaaagcggttcatgcagattcaccacaggcgtttatttcgcggttaacacctgatgttaaaacagtttccaataaatataatttatatggatctttgatgatggctcaagcagcctgtgaaagtgcttggggacaaagtcaattggcggtcaaaggtaataattattttggaattaaaggtacatataacgggaaatcggtgacgatgcggacggctgagtacacttcatcaggcaagctttactatacaaacgcaaagttccgaaaatatcctaatgtaaaggcatcgttgaatgataacgggaaagtgcttcgttatggaacggcgtggaacagttcctattacaaaggaacttggaaagaaaacgcgtcaacgcctgaagctgcagctaattacttaactggtcgttatgcaactgcaccttcctatgcgaagtctttaattagcattatcaagggatacaatttgcatgcgttggttgatggagtcgcagttaaatatacgacaaagaaactaactatgcaggtcagattaaagcctggtcataatttctatacacatattcccggtagtacgtatacctataaacttaagcattatggaacaacctataaaggaaaaacaattacgattaataaccaaggtgttaagcgtggagctaaaacaccgtactatcgctgctattataagggaaaattaattggctggatttattctactgccgttgtgcaggtcgcaaggtataagacagttaaaaagacagccacagtgagtgcggcaccttccaatgatttttataaccatttgacctatagtgtttacgcgactaaacgacttcattatggtaagacgtataaaaatcggaatgtgacaattaatatgcaagccctccgcgtcggaactaggacaccatattatcgttgctatattggtagtaagcaaattggttggatttatggtggtgctttaactaatgtggttgatgcttaacacaatttattaaagaagtatgagcaaaaattaaaaacactgtagactaaaatgagaaaatgaggtatattgtaattaccatttatttatttcctcttcctgtttaccccaaatgaacatagttgagggacatctctacgatgtatacatcagatggtgaggatcagaattacattctggtccttttttattaccctttaaatattaaaaaatagtttgacaccgcttacataaaaaggtatgattacctttgaaaggtagtagtgcatctcctctacctttaatcaattctctttctctcttatgccaaaaaggtgtgttctgaacggaaattcagaacactctttttttctttttgaaaatcacttgcttcacagattgtttgtcctctatacttaatggtggaggaatgatactgatgggacaacgacaacaaacatttacattaattgaagaaattacgcgtaatgatggttcaaaatatacagagattgcaaacatgatcatgaatgggcgcgctgaattagcagcggaacgtcattttattaaggaagttcgaattttgcaattgaacattccacattctgctcatgttgtgaattatgaggattatattaacgaacgctatcaggtgcccgaagaagatatggatcattgggaagaatggaaaaaagacgataagattatgacggattttaatgctgttttaaaagaaaatcatatttcataagttatattccggtcaaaactgactatctgggcatcaattattaaaatttagttgacaagtctgtggttttcatgatataaatataaacatagtaatgctccgtagttcagtggtagaataattgactgttaatcaagaggtcgctggttcgagcccagccggagcagtatatatgattttgaggtcgttatacaacggtaaaacgttgatataacgaccttttttattttccagtcttttgaatgtcattggcatagtaacattttcatttgagttggtaactgctaaactaaagtgagctaaaatttttcagagtagtagttattatgaatttatgtagttacagatccaccatattcagtttttgtgaatttaggtcctcaaatataaaattctcgggggggagtaattaaagtgaatagaattagacgtatcacgatttggatggtcagtatcatttgtttactcgtactttttacttttgttcagtcgacggcaccgacatatattgaatcaagtcgaacgcgtatgaaatcaatggaatgcagggtggggttgatagtaaaaagtttaatagggtggttacaaattacaccaacaaacatcatgtttcggctataaaggtgtttaatgtgcaaaccgtaaacgatacaggaaatacccaaactaaaatgtacgtttatggaaaggccagagtgcctaaagaatcgcttgcttcaaaacaagagatgcaaacgagtgatattcgttatcccctttactttgtcgggcatgttagtcagggttcgattcaacgaatgtttaaacgtaatggtatccagtacgcccaaatcaacgagagttggaattggaatatttctaattttctgaataccacccaaatatctagtattctaatattggtttttttagtaatgggaatcgttattattttggctaatttacataacttaaaaaaagccaatgttcgtaatttgttgggcatgtcgaattttgatgatgcgtttgacacttttgtagatgatcaaggctgttttttaagtagttatttacttggcattgttgtgctgataatttatatgtggataagtaagttcacgaattgttatcgaatcatggcttattttgcattgttgttatacttaggagttattttggtaactggagtagctgctatcttaagggcccattcacattctgaacgaaccattattggtgccatcaaaggtaatgttaaaaataggcttgctttttatattaatatgattaaggatttgacttttgttttaactgcctttttagcttgctttaatcaatttgatgatcgaaattggaaaaattaaacgtgcttgcttggattaactgccggcttattgtccaaatcagttctaacgaccaggacatcgcaaaccgcagttctggtaacatattcggtaaccgaaccaattaagagtcgttcgacggcattcaaaccagttgcaccaatcatgatgaggtcgatgttgaggttttgaggaatgtctctggcaatcacggtctttggtgcaccatattcaattgagtaatcaacatcgttgagccccgctttttttgcatcttcgatgtatttgtccaaagtttcctttgcagtatcggtcacttgttcgaccattgatgtgtcaaaacttgaaatattttgaaatgcacgtgtatcaacaacgtggactaagtgaagagatgcattattacggatcgcaactgctacaccttttttaaaagctaattcagcctcgtaggaaccatcaactgggaccaaaatttgtttatattgttgttgtaacattatgcccaccctcatttctatctgtttaacttaattgtactttactttcggcaaaatacaaaggaataaatctattaccgttgtttatggttaatgacgttgagaattgcgaattcaacaaccagaccatgtgcagtcatccacaaaagaaccactaaaatgagaatatcattttgaatgattaatgccagaacgcccaaggctgccaaaatgatgaacatgatgccgccgtttttggcagctcctttcaggcggggatcatcttgaactgaaatattaaacatggttttgtgaaggtgggaaagtaagtagtagccaatatatagggcaattaacacggcaacagctactaaaatattaattatcattattacactccaatactatttatgaccggctatttatgaccggcagattttctaagcttggcatattgttctttaaacgcggcctcaattcgaccgttttctttcgggtggtaatactgagcatttttgattttatcaggcaggtattgttgtttaacccagtcgttgggaaaatcgtgggggtatttgtaggtcaccccgcggccaagtttcttggcaccttgataatgcgcatctttgaggtgcagtgggacatcaccatagttaccggatcgaatgtcacttacggcaccatcaattgcggccatcgcggaattggacttgggacttaaacaaagctcaatgattgcgttagcaagtggaattcgtgcttcgggaagccccagttgacgcgcagcgtcaacagcagcaaccgttctttgacatgctcctggattagccaggccgacatcttcataggcaattaccagtaatcgccgcatgatcgaaaccaagtcaccggattcaatcaatctgccggcataatgtagggctgcatccgtatccgagccgcgaatcgatttttgaaaagcagaaatgacgtcgtaatgggcatcaccatttttatcggaattgagtgcttttcgctgaaggcattcctcgacgattgcctgggtgacggcgatttttccctgatcatttttgggtgtcgacttcactgcaagttccaaggcatttaacgatgagcgcaaatcaccattagtggcagttgccaaaaagtttaacgcttctttggtaatcgacaccggataattacccaaacctttttctttgtcgtttaacgcgcgattgagggctttttgaatatcagttgcggtgaggggatgtacctcaaaaatttgggttcgcgatcgaatggccggattgatgttaatgtatgggttctcagtggtggccccaattaaaataattgagccgctttcaagtaatggcaatagaaaatcttgttttgttttatcgagtcgatgaatttcatcgagcaacaggacgaccgtgccgctcatcttggcttcctcggcgacaacctgtaaatcttttttggtgtcggtagcagcgttgagaactcgaaatgcatatttggtcgagccggcaatggcgctggcaatgctggttttcccagttcccggcggcccatataaaatcattgacgacagcatcttggcacgcaccatccggtcgattattttacctgggccgactaaatcctgctggccgacaatttcttcaagcttggtcggtcgcattcgataggcaaggggttgttgcatactcatcctcctctcaaattgtgatggttaaaaatcaaatcctataaattataacatgatcgtgagggcacaaaaaaagcgttttgcataagcaaaacgctcgctgaatgattaacccaacttgttgtagtattcaacaatcagtgattcatcaatatcagcatcaagttcttcacgttgtggaagacgaaccaatgatccttcaagcttgtctgcatcgaagctgacgtattgtggacgacccacaacagcttcaacagcatccttgataacttggaggtctttagacttctcacgaacagagattacttgaccaggttgaacttcatatgatggaatatcaacacgtttgccatcaacagtgatgtggccatggtttactaattgacgagcttgacgacgagtagtggccaaacctaaacgataaaccatgttatccaaacgctcttcaagtaagatcatgaagttaacaccatgcttaccttcacggatcttgccggcacgaacgaacaagttactgaattgacgttcagtcagtccgtacatgtaacgaagcttttgcttttcgtgtaattgcaaaccatattctgaaagttttgaacgacggccttgaccgtgatcaccaggagcataaggacgacgtgagagttctttaccagtacctgacaaagagatacccaaacgacgtgaaattctccaacttggacctgtatatcttgacataagtaatcctccaatatttttttggagtaaaataagccgttgcagacttagtattcgtgcatgttgctttgctctttcgctcaagcagccgattgagttacttgcagaaccaattgaatggcaacaacatgttgacgagcttaccgtctactgctgcgttattttacacaaccatcattgtataaagatttctactgtaagtcaacatgtttgacgaagatgtcggcaaactggttaagaacctgctcgtcttcactcgaaaaacgatcgagtgatggcgaatcaatatctaagacaccaagggctttgccgtctttaaacagtgggacgaccaattcagaattggaattggcatcacaagcaatgtggccggcaaattgatgaacgtcggcgactcgtagtgaatgcttttgtttgagagccgttccgcagacaccatcaccatttttgatgtgcatgcaggcaacatttccctggaaggggccgaggatcagttcatcgttagcgggcacataacgataaaagccgacccagttgatatcttcgaggctgacttggagcaatgcagcggcgttagccatgttggagatcaaatctgtttcattttctaagagtgaatcaagctgttgattcactaaattggtaacgttttgcataattgttttcctcacttcaaaaataatatggtgaaaaggacctactatgatataattcaacttagagcacattaattgattattcatacatattaaattgttttgggcaattttactaccataatgttcaattatatatctttatttctgaaggatgggatcgaatgcttactttgttgattggagttatcgtgttggttggggcgggttatcttggttttgttttctaccaaagaagaacaatcaagatggcaaccgatgtttacgagaacaaacgggatttaaacaaaattccgttggatgatgagtttgcgctggctaagaaaatgaacttaaccggtgaatctcacaagaaatatgatcaattatacaataagtatcagcactacaagaaccaaatgctgcccaatattgatgaggggattgcggcagtcaaagaagacggtaagggcattaactttttaaagaccaagagtgactggcagagtgctaatcaggccatcgccgacgccgacgccaccttaaaagaaattcaggccggccttgctcaactatatgatttaaacaagcagcacaaattagcgctggaagaacttgaaaagaagtacaaacgcttgcgagaggacatccttaacaagaacgagtcatttggcccgagtatcgacagcttggaaaaaatgctctcggacattgagggaactttcgatgaatttacgcaacttaccaagagtggggatcccaacagcgccgaagaagtgttgagtgacctcaacaattcgactgacaaattagaatcctatatggggcgaattcccaaactatatcaactactttcaaaggaatttgttgagcaggttgacgaaatcaccagtggttacaaagaactcaaaggaaaacagtataatttccccaacgataagttcgatgaaacgcttaaggggatttcagatcagataaaagtcaacaccaataagttaaagactttggaagttgattcagtggaaaaggccactcaagatattgccgaccggatcgacaaattgtatgatgcaatcgacaaagaattccaagcccgtcccaaggtcgagaagaataccaagattatcggccaatatatcgaacatgtccgtaaacagaacagcgacttgcagctgcggcttgaaacattaaataaaagctatattttgaaccatcaagaaattgagaataatcatcaatttgatcaacaaattgccaccattgaaaagaagtaccaggatgaagtcaacgccatgcaaaatgggacggctgtttattcaacgattgacgccgaccaaactcacatgatcaaagagctgggtcagatcgagtctgaacaaaaggatttattctccgcaacagttaagttgccagagcaagagcaggcagccagaaatgcattggccaaatttgatttggcaatgcgcaataccaaacggcgaattgataatcacaatcttcctggactatccaacgattatcaagatgcttttgcagcagtcattagggaaatcaatcacctggacgatgccatgaatcagccgcagattgatgtcgatgacatttccaaacagttaacaattattcaatcggatatggacactttggatgaaaagaccaaccagttgattgatgatgccgctttggccgaacagacaatgcagtatgccaatcggtttattggcagcaactctgaaattgcggcggccagcaaaacggcccagatgtattttgaccaaaaatatgattatgagcagagtttgaatatcatttccaaagcattggaaaaacaatcgtcggggatgtttgccaagatcaaagatgattatttcaatgccaagaaacatttaaagacagaaaaaaccgatgaagatgaatcataatatgacgtatgagacgaagctgaatgttcaccaacagcttcgccttttgttttccatcattgattgcccagcgacaatgcttgtgagactcacagtttgggtgtatcatcgtgggagttatatttgttggagtcgaaccaataaatttagagaagaaggtttcaaatgatttattttgataatagtgccaccacaaaagtcttaccagaagttcttgacacttataacaaagtgagtgagcagatttggggcaacccatcgagcttacacaactttggtgaacaggcgtttaatctgttggaacagtccagaaaacagattgctgatttgttaaacgttcacccagatgaaatctactttacgagtggcggaactgagggtgacaattgggtcatcaaagggactgcaattgaaaaacgtgaatttgggaagcatctgattaccacctcagttgagcatgcagcagtgcgcaactcttttgagcaacttaaacagctcggatatgatgtgacttatttaccggttgatgatgaggggcggatctcgattgctgatttgaaagcggcaattcgtccggatacaacgctggtgtcaattatggcggtcaacaatgaaattgggacgattcagccgatcaaagaagcgggcgaactgctgaagaactacccgaaaattcattttcacgtcgatgctgttcagggcctcggcaagggaattcaggatcagattttcaatgaccgaactgactttgcagcattttctgggcataaattccatgccccacggggaaccggctttatttatggtcgacgtggccgtcgaattgcaccgttaatgaacggtggcggccaggaaaagaatcaacgttccggtactgaaaatctgccgggaattgctgccatggccaaagcgatccgattggtgcttgaaaaagagcccagtgcaattgatactgagcgccagattaagcagttgattatggatcacatcagtcagtttgataaagtcaccattttttctaagaatgatgatacttttgccccgcatattctttgttttgcaatcaagggggttcgcggagaaaccatcgttcatgcttttgaaaagcaggggatttacatttcaacaaccagtgcctgctcatcaaaggatcatactgaatccggcacgttgaatgccatgcaggttcccgatgatattgccaccagtgccgttcgaatttcacttggagatcacaacacacttgatgaagccaaacaattcgtaaaagtatttgaccagttgtatgaagaatttgacaaattaagttaggagtaactatgcactatacagaaattatggttcgttacggcgaactgtccacaaagggcaaaaataaaaaagactttattaagcagcttggcaagaatgtgcgggctgttctccatccatttcccaagcttgaggtcaaaccgcaacgggatcgtcttcatgtggctttaaacggtgaggatgaccagcaggtgatcgaaagcctgaagggtgtttttgggatcgaaaatttctatccttctgttcggcttgaaaaggatatggcaatcatcaagcagaccgcccttgaaatggtgaaagaacagtatcatgacggagcgacgttcaaaatcaacacccgacgtcaggataaacattttgaatacgataccaatcagatcaacaaccagttaggcgattatattctcgaaaatgtgcccggaatcacggttgatgtcaaacaccccgatatttccattcgagtagaaattcgaatgaatggtgcctttctctcatcagaaaagattcatggtgccggcgggttgccggttggtaccggtggtcgggccacaatgatgctgtctggtggaattgattcgccggttgccacgtatttggcaatgaaacgtggtgtcaaaattgatatgattcacttttacagtccgccatataccggcgagcaagccctgaataaggccaaacagttaacctcagtgttgggcaagtactcgggtaatattcagttcattcaggtaccgttcaccgagattcaagaaaccatcaaggaaaaggtccctgaaggttatttgatgaccatccagcggagaatgatgctgcggattgctgcccaaattactcaaaatcgtcattgtaccggcgtctttaccggcgaagcactgggacaagttgcctcacagactttagagagtatgatggcaattaacgacgtcaccacgatgccggttcttcggccgctggtctcaatggacaaaacggagattattaagatttccaagcagatcaagacttacgacctgtcaattctgccatttgaggactgttgtacgatttttacaccgccggcaccaaagactcggcctgatttggccaagtcacgtaagtttgaacagtatatcgatgttgaagggttgatgaaaaaagcaatcgacaacattgaaattaccgatattaaacctggcgaagaattcctaaaccaaaaccaggacgtcttcgctgagctgctttaatgatcggggacttgcgtattccgtttgtttaggctacattatgtataaagtcgttagaccaagggagtgcttttatgaaaatcacgatcaatggtaaagaagagagtatgtttggcaatccacccgaagtcggtgaacaactgccaaagtttaaacttgaggatgcagatggcaataaggtgaaaactgctgacattattggcagaattaccctgctgtcaacggttccggatattgataccccggtttgttcagttgaaacccgcaagtttaatcaagaagcggataagtttcctgatgtccagttcttgacggtttccaacaatacgattgaacagcagaagaattggtgcgctgctcagggagttgccaatctgcagatgctgtcggacgaaaacctctcgttgggatacgcaatgaaactttatctgccaaactttggtgcgttggcgcgaacaatttttattattgacgccaccggtaagattatttaccgccagattgttccggaaattggtaatgagcctgattacgatgatgcactaaatgctttgaaaaaagttgctcagcgtattgacgattagcagatatttagttaagattaaaattaaattaaagtgttgagcaagagagtagccaacgtttcggtttcagaaagaaaatcattgctgtgagatttttaccgggcgttgagtgaaggtagcttgtgagctgcttatcttcaattgaagatgagtcggtattatcagaccgttattatgatattaagtggggcttttcagcccaatttaggtggtaccgcgaacacttcgtcctaatttacaggatggggtgtttttttattacataaaaacgatttgaattttggaaggagtgacgttatgtcagacaaattgcacgaaatgtcaacgaagtatgatccaactgccgtcgaaaagggcagatatgatgaatggcttgatgaaggggtatttacaccgagtggggataaaaaggccaaaccattttcaattgtgttgccgccgccaaatgttaccggaaagctgcatttgggccatgcctgggatacaacccttcaagacatgattatccgccgcaaacgaatgcagggatacgatactttatggctcccaggaatggatcatgccgggatcgctacccaagctaaagttgaagccaagctgcgtaaacagggtatttcccggtatgatttgggccgagaaaagtttgttgaaaaggtttgggaatggaaagatgattttgcccgaaccatcaaggaacagtgggccaaattaggtctttctctggactacagtcgtgagcgattcaccttggataaaggattgtccaaagctgttcgtaaggtctttgttacgctttacaataaaggcctgatctaccgcggtgaatacattatcaactgggatccgcaagcaagaaccgccttgtcagacattgaagtgatccataaggacgataaaggtgccttttaccatgttaaatacccatttaccgacgggacgactttcaacggcaaagattacatcgaaattgcgaccacccgtcccgaaacgatgatgggtgataccgcggttgccgttaatccttctgatgaacgttacaaagatatcgttggcaagaaagtccgcgttccattgattaatcgtgaagtgccgattatagccgatcagtacgttgaccctgactttgggacagggatggtaaagatcaccccagcccatgatccaaatgactttaaggttggtaatcgtcacaacttacaacgcattaatacgatgaacgaagatgcttcaatgaacgaaaatgccggtaagtataaaggcatggatcgttttgaagccagaaaagctatggtcaaggatttgcaggatgaaggcttgatgctctcaatcgacccaattgtccattcagttggccattctgaacggactggggttcaagttgaagcccgtttgtcaactcagtggttcgttaagatgaaaccgctggctgaacaggccattaagaaccaggataccaataacaaggtcaactttttccccgaccgttttgaaggaacctttgaacagtggatggaaaacgttcacgactgggttatttcccgtcaactttggtggggtcatcaaattcctgcttggtacaacaagcagaccggtgagatctacgttgggatggaagcgcctaaagacgccgaaaactgggagcaggatccagatgttttggatacctggttctcgtctgccctgtggccattttcaaccatgggctggcccgatgatacagaagacatgaagcgctatttcccaaccgacaccttggtgaccgggtacgatatcatcttcttctgggtttccagaatgattttccaaagcttggaattcactcatgaacgaccctttaaagatgtattacttcatggtttaatccgtgattctcagggacgcaagatgtccaaatcccttggaaacggtattgatccgatggatgtcattgataaatatggtgccgatgcccttcgctggttcctgtcaatcggtgggacgcctggccaagatttgaagttcagttatgacaaaatggactctgcttggaatttcattaacaagatttggaatgccagtcgttacgttattatgaaccttgatgggattgacaagccggaattacccgacaagtccgagtggcaattatctgacaaatggattttaagtcgactgaacgctactgtgaaccacgtttcagacttattcgagaagtacaactttggtgaagccgaccgttatttgtatgacttcatctggaatgatttctgtgactggtacatcgaaatgagtaaggaagctctcaacagtgacgatgagaagttgaagaagaacacccaaaacattttggcttacgttttggatcaaacccttcgcttactgcagccgatcatgccattcgtcaccgaatatatttggcagatgatgccacacgttggcaagtcactggtaaccgccgactacccagtggaccacaaagaatttgacgacccaacttctgagcatcaaatgcagtcattgattgatttgattacggcagtgcggaatattcgaaatgaagccaacgcaccgctgtcatcaccaattgatatgttaattcaaactgacaatcagaccctcaaatcaatctttgaatccaaccgcgactacattgaccggttctgccacactcaggaattgcaaattggcaaagatattgaagcgcctaagctgtcaatgtctgcggtgattacggatgcgactgtctttgttccattggccgaattggttgacttgaaggatgagcaggctcgggttcaaaaagatgtggataaatttgaagccgaagtggcccgttcagataagaaactggctaacaaacggtttgtggagaacgcgccggatgcagtggttgctgaagagaaggccaagcaggctgattaccaatcaaaattggatgcagccaaagaccggctccaacaaatttccagcgagatgtaaagtgatttaactgacttaaatttttaaaaacgtgggactaaatgctgtttcctggcacatgccaggctataagccgcatttttgcccacgttttttaaggagaaaataatgattaacacatatgatgaagccttggctttcattcatggacggaccaaattcaagaaaattccaaccttaaaacggatgcggcgattcttagacgaattgggtgccccggacaaacatgtcaatgcgatccacattgccggcactaatggcaagggatcgaccttggcatttttacggaacttgtttcaagcggaaggcaaaacagtcggcagctttacctcaccgtttttgattaaatttaatgagcgaatcagcgttaacggcgtcggcatttctgacgatgaaattctaagactcactcaggaaatttatccgacgattgccaaacttgacgccgagttgccggaaggcggcccaaccgaatttgaaattgtgacagctatgatgttcaagtactttgctgaaggacacgctgatattgttttgattgaagtgggtcttggtgggctgtatgattcaaccaatgtcattatccccaaagtctcggttattacgtcgattggctgggaccacatgcacattttaggggatactttgtccaaaattgctttccaaaaagcagggattattaagccgggcgttcccgtagtcgtcggcggagttgaccccgaaccgctcaaggtgatcgtgaaccaagctgagcacaagcaaagcccgattcagattctgggacagaattttaaggtcaatgatcgcggtgagcacaattggaatcaagaatttgactttagttccgctgactttcaattgcatgatttaaaaacagccttaattggtgattatcagactcacaacgctgcgttggcgatccaggcatacattgactaccaccagctcacaaagcgcgctgtggatgtcagaaacattcaaaagggaattgcagcaacacggtgggcgggccggtttgaaaaaatttccaccaagccgaccatcgttttggatggtgcgcataatatctcggcagttaacctgattgtcgataccttgcagaacgattttccccagggccatatttatattttgatgggcattctggcagacaagcaggctgataaaatggtggacaagatggccaccgttcaaaatgcatcgatcatcttgacccggttcgccggaccaggaaaacggctcgcagctaatccagaaaaattggaaagtcaactgaaaacccaaccggaaaatgtttccgctattgatgattggcaagacgcaatcagggaattgagacggaaactgacgccggatgatatgctcttaattaccggatcgttatattttatttccgatgctcgaaagttcttgttgaatcccgatcacaatttcaaataatctattaaatcgggcgtcgtttcacttgattttatttatttttggacgcgttatgatatacttgtttcgttaaacaataataaataaatctataaaaatcgaactcaattaagttgatagacaacgaagggatggataacgtgtttggatttggggaaaaaaacataggaattgatcttggaaccgctaatacgatcgtttacgtcgagggcaaaggaattgtccttcgcgaaccttcagtggttgccaagagcactaaaacaggcgaggtaatcgccgttggtgcagaagcgcgagcaatgattgggcgcacaccagcaagtatccaagctgttcgaccaatgaaagacggtgtcattgcggattacgataccactgttgccatgatgaaatacttcattcaaaaagccttgggacactcatcaggtaagccatacgtcatggtttgtgtgccaactggcattactgccgtggaaaaacgggctgtcattgatgccacccgggtagccggtgccagagatgcctatgtcattgaagaaccattcgctgcggcaatcggtgctggacttccagtcatggatccaaccggtagcatggttgttgatattggtggtggaacgactgacgttgcaaccatttctttaggcggcattgtttcaagccgctcagttcgaatggccggcgacaagcttaacgaagcgattgctcaatatgttcgtcaaaagtacaatttgttaattggtgaacggacttccgaacagcttaaaattgatattggttccgcttctgccaaggaagctaaagaaatcaaagccgttccggttcgtggccgtgatctggtaaccggtttgccaaccacagttgaaattagtggaacggacgtcaacaaagcaattaacgaatcagtgttggccattattgccacgattaaggaaacccttgaagaaacatcgcctgaaattgcagccgatgttattgatcatggaattgttctgacaggcggcggcgcattactcagaaatattactgatgtgattgcggaagccactcaggttccggtttccattgcatctgatccacttgattgtgttgccatcggtactggagaatcattaaagagcattaatgtaatgaagaaaaaacaataattaatcgtttatatcgattcattattgaataacgaatggaggcaattatgcaaaaatttttctccagtcgaaagcttgtgattgtcgtaatctgtttgatcgtcagttttggtttaatgtcgttgtcggttgccattcgggacaagcggagcacaccgccgttggtacaacaatttggaaatgatattgttggttttgctgatcggattgttgccgccccaatgaacggtattcatcacggatttgtttcaactaagaatcttttgaacacttatcaggaaaaccaacgtctcaagtcaaaagttgatcaattgacccaaacacaggtcaaggatcaggttttgtcgcgagaaaataaacaattgaaacgtcaattaaacgtcggcagcactttgaccggatatgaaaaaattaacgcagctgtcattacccgaacaccatcatcatgggcaagtcaggtgatcattaataagggtcaagcttctggaattaagaaggatatgcccgtgatcgccggtcctggactgatcgggacagttgctgaagtcaacaaaaccaacagcaaggtggttttaatttccaacaccgccgaaaactccaaccggtttgccatccaagtgcttggcgataattccaaagttgttaatggtattatcacctcgtatgattcggctgccaaccggattatcatggggaatattacttcgaacgccaaattatcagttggcaatcgggtgacaaccagtgggcttgggggcgtcattcccaaggggatttacgtaggtactgtttcaaaagtgacccaagacgattatggccttgccaaaaaagtttatattaaaccggctgccaacttaaacgacattgaagttgtttcagttgcaatcagagattgatgggagggacaattaagtgaaacgaaaagttcccattgcagtttactttgtaattggtcaattcattgcgttctttcttgatggttccatcagccagacaatgtccggtattttgtttaaatatcccaacacgatggtgccgtatttaaccgtcctctggttgattttggcagccttctttggtaatggcaaaaaattacatctatacacctggtccgctgtgattggctttatttttgatatgtactacactggattgcttggggtatacgtgtttatttttccattagtcgtttatttatgccaattggtttaccaaattttgccaccaaatttcatgagtggctttttggtgtattttttaggaatcacagttttagttagcctaggatacatggccaatgtctttattggggagacggactcatccgttgctcagttcttagttaacacattggcacctacactggctctcaatctggtgttattgacaattgtttactttccggttgaggcactctataggactcataggcaataagaaggggagtagacaatgcaagatgcagctgtattaaagggcaccaaggatggttatgaaatcattctggatgagaatgccaatctaaaggatattttttcctcacttcgaaaacttctggataatttgaaaacccagacggcatcaactaatccgcaaaccattgcttttgatatttataccggaatgcggttatggccagctgctgaccgttctgagcttgagaaaatcttttcggattattcgacgttttcagtgcataagattacgtcagatgtgatcactaaagaggaatccaatcggattttggaacagtccagcgtccacattgttgatcgggtgattagaaacgggcaggaagttcacatccaaggcgacgtcttatttctcggcacggttcatgagggcggcaaactgtttgtcggcggtaacatttttgttctgggcaacgtccagggaattattcaagccggcgcaccggatcttgaggacaagatgattattggggatgtacataacgcacaacaagtccggatcggcgaacagttcgaaatagttgctgacatgaaacgtgaaatgaacagcggcacagtgatttatgtgaacgatctgcatgtactggattatggtaaagttgagaatcttaagcagattaatcccaagttttacaatcagataggaggagtcatcaatgggtaaggcttacgttataacatcaggtaaaggaggagtcggtaagaccacttcttctgctaatattgggactgcactggccatgctcggtaaaaaagtggttcttttggatcttgatattggattgcgtaacttggatgttgttttgggactcgacaaccggattatgtacgatattgtcgatgtcgcagctggacgagccaagctcagtcaagcactggtcaaagacaagcggtttgatgacttgctttacctattgccggcagctcaaaatactgacaagacggccctaaatgaagaccaggttcgcgaaattgttgatgaattgaagcctgactttgatttcatcctaattgattgtcctgccggaattgagcagggcttcatgaacgcaattgctggtgccgatagtgccattattgtgacgactcctgagatttctgcggtccgagatgctgaccgggtggttggtctcttggagcagcatccgcttcaagaacagccgcatctgattattaaccgaattcgtcaacatatgatgaaagacggttcggtgatggatgttgatgaaattacccatcatttaggggttgaactattggggattgtctttgatgatgatgcagttatcaccacttccaataacggcgaactcgttgttcttcaagcggaaaaccctgctggtcagggatatcgagacattgcccgacgactagtcggtgaatctgtgccattgatggaaatcaaagatgaacagcagccttcattctggcaaaaagtcagtcattggttccgtaaaggataaaagtccttgacgggaagcagaattaatattattataaatctaacttaattaaagatttttaaagacgttgatcagaaccgattaatgagtcaaatcacagagagcttatcaaggtgggagttaagcatttgagcgttaatcgtcacatctgggagtcatttttctgaagctgagtaggaaaaagcggtaagcacgttattgctgaagtttagtatgttgcatattaaacccattgaggcctttcatgtgagtgagaggtgaatcagaggtggaaccgcgaataatcgtcctcttaagtcatcatggcttaagaggattttttattttaaaacaagactaaacttcacgaggcagcaggtgtgaatctgttgcgaattgaggtggaaccgcgaaaaccatcgtcctcttgagtcaatgtgtactcaaggggatttttttatggagggatgtcaaatgattcaatatatacaagaaattttaccggccttattatctggaaccaaaatgactttatcaattttcttctggacattgatttgttcaattccattaggggcattagtcggattaggactcatccaaaaatttaaaccgctgacctggctgcttaacttttacgtttggattatgcggggcacaccactgctattgcaattaatttttgtgttttatggattaccgattgttcacattgtgttccaacgttacgatgctgccatgtttgctttcatcttgaattacaccgcatatttcggtgaaatctttcgaggcggtttccaatcagttcccaagggccaatttgaaagtgccaaggtgctgcgattgagttatggccaaacgattcgaaagatcgtgattccccaggttttcaaaattgttctgccatcaattggtaatgaagtgattaacctggtcaaggattcctcattggtctacgttatcgggttgggcgacttactgcgagccggtaacgtcgcaacggccagggatgtcacactgttgccgctgatattggtcgggattatctatctggcattaaccgctgtatgtacgattgtgttgaagttaatcgagaaacgtgaaaatgtttggcattaggaggggattacgatgttagagattaagaatttaaccaaacgatttggcagccgaaccattattgatgacttgtcgatgaccgttaaagataatgaaattatggcaattgttggcccttccggtgccggcaaaacgactctgttacgttgtattaccggtttggagtcggtgaataccggagaattttactggaatggcactcagtttgatccaaccaatacgactcaaaaagacacaatcatcggggtagttttccaagattatcagttattcccaaacttaacggtcctgggaaacattactttggcaccaacgatggtcaaaaaagaaccgatggctgacgtcaaaaaatatgcgcgggaattattgagtcgcttgggcttggaaggcaaagaaaatttatatccttatcagctttccggcggccaaaagcaacgggtcgcaatcgttcgggcactggcaatgcgaccgaagatcctttgctatgatgagccaacgtcggcccttgatcccgctttacgagatgaagttgcccaaatcatcttggatcttaagaagcaggaaatgacccagatcgtcgtcactcatgatatggattttgctaaaaacgttgcggatgaaattcagcaggtcaaacaaattcagtaggaggggtaaaatgttaaaatctttgaaacgattattactcattaccagtctcctactcgtgaccgttgggttatccggttgcggggtacgctatgtcagtcgccaaggctcacaggaaaatccggatacgtggtcgacggtttccaagcaaaaaagaatcgtggttggtctggatgacagttttgtcccaatgggctttcagaccaagagcggcaagattgtcggctatgatgtcgatctggcccgtgccgtgtttaaacagtacggcatcaaagtggactttcagccaattgattggtcgatgaacgtcaccgagcttcgaaacggcacgattgatcttatctggaatgggttctctattaatccccagcgagcaaagaagattactttcagtgaaccctatctaattaatgatcaagtattggtttccaaaaagaatcaacatatcaacagtttcgcagatatgaagggaaaagtcgccggcgtccagagtgggtcggcaggggccatggatattgataaccaacctaaattgctgaaagataagatcaagggccacgagccaatcttatacgacacttttacagacgcgttcatcgatttgaatgccaaccgaattcagggattgctgattgacagcatttatgccggttattatttggaacatcaaccaaatcaatccagttttaaatcgattcccagtgaatttcctaaagaagaatatggtgtcggcatgcgaaaaggtgatacggtcttgaagcggaaaattgatcaaggtctcaatcgattagccaaaaatggcgagcttcacaaaatcaacatgaagtggtttggaactgatcgtgacagtccgctcattaagaatgctaaataattttgatcatcaatagtctgtggcaaacacgatttgtcaacagaccatttttgtattcgaatcctttgccgatcaattctctatttttccttattattggcagattatattgagattttaatgattttattttatgataaaatttgtgactaattgaggaggaaactcagtgaaatacgagattgcaaaagggattagcttgacgacaatccccaccacaaaattcaaaaataataaattggtgatgaatttcacctttccggcccaacatcaaaactacgccaaattggcactgttggctgaactgctggaaaattgctctgcccaatacaacagtgagttgttggtttcccgccaactgtcaaaaatgtacggggccagttttggtgtgactgtcttaaggtatggcaatcagcataccctgcaggtgtcgattacgtttcccaatgacaagtacctaccgccaaaaagtgagctaactagtgaaatattggcatttctaaaggaaatgattgaggatccatttattgaaggcgatcagttcaaccaagcatattttcaaattcatcaagggaatatggttcattatctggattcgatccaagataacaaggagttcttctcaaccttggagcttcaacgtttgtattacccaaatgatcctgaccatggtcacttcctgatgggcagtcatcaagaaatgagccaaatttctgctcaagagctgtacacattttatcgatgggtccttaactcagcgaagattaccatcttggctggtggcgatttaattgacgaccaacttgtaacgggatttaaagaatttgcctcatttactgatcgaatgccggaagactatcaattaagagttgtgccggcaccaatattgcaggtccaacaaggaaccaaagtgattgccggttctcagtcagttctcagcatggcttacgaactaccaatctattttggggacgatgattactttgcttccgtcatttttaatcagttatttggtgggtcaagcagatcgttgctatttacaaacgttcgtgaaaagaacagtttggcctacgacattcatagtggctataattcattagtcggaatggtaaccgttcaggcggggattgattttaaagatgaagatcgcgttattcagatggtcgccgatcaattgcagcagaccagcgacgggaagtattccgatgaattgctcgacggtgtcaagcaggcattgattaaccaacatcgttcagaagccgatcacctcggatcattgatcgagaagcagtatctccagcagatgatgggctttagtttgagtgataccaaatgggagcaacaggtcgcttctgtgacgcgttcgcagattgcccaagttgccaaacggttgactttacgagccatttatcagttgaacagcaggggggatgcataatggaattgattgactatccaaactacaatgaaaaactatttgttcagaccctctcaaatggattgaccgtttatctccaacccaaagcagggtttaataagacgaccgccgttttgggggtgaattatggctccgttgacagtcagttcatgctgaatggcgaaaaagtcgttcaacctgcaggaattgcccattttttggagcataagatgttcgataaaaaggattacgacgtttttgagctgttcaataaaaccggagcgcgttcgaatgccttcacaagttttaccaagacgaattacctcttctcaactgccgaatccgtgaaagaaaatttggatattttgttggattttgtccagattccatattttacccaagctaaagtccaacgggaaaagggaattattgatcaagaaatcaatatgtatcaaaatgatccggacaatcaggcgtactttaaaacgattgccagtttgtatccaaactcggtgttggcaaacgatattgccggcgacattcagacggttgataagattaccctggaagatgttgagttggcttatcgaaccttttaccggccggaaaatatgagtctgtttatcaccggcaaactcgatcccagcgaagttatgaactggattgaggataatcaacggcgaaaatcgacaccggcacccattaacctgcaacgccgactgacgctccccgaggcatccaaagaaaccgttctccacacgaaaatggatgtttccaggcctaaaataacgctggggctacggggaagcgaccaagtaccaacaggccgggatggactaaagtacgaaatcgccatctctgtgatgtttgatctgtttttgagtgaaaactccgtggaatatgataaactgtatcatgatgaaatcattgatgacacgttttcatgggaatttgaaaatgaacgcggctttcattttgccgtgattaacggcgatactgataagccattggaactcattaaccggctcaaacaaatcattgcagatattccaaccaagattggtcacctccaagccgaatttcagttgcaaaaaaacgagttatttggcaactacattgaaatgatggattctgaagaagcaatcagtggccagtttgatggatttatcggtgaacctgttacaatatatgatgaggttgagattctcaaatcattaaccttgggggatgtttttgaggcggcccacagttttttggaccaagcaacagttcaagaagtgatgattcaaaattccgaccagccaaagggatagttgataaattacagtttatgaattacttaaaataatcaaggctttccttatgatatacttagtggagaatacaaaaaattcaatggagaatgagtatgagcgacgaaaaagataatttaacaattgggaaaaaactacatgacgcacgagtggccaaaggttacacgctggatgatttacaaaagaacactaagattcagaaacgctatctaattgcgatcgaagataatgattttgacgccttgccgggtgatttttatgttcgagcatttgttaagcagtatgccgattcggttggtctggacggaagtgagctgctaagccagtttgatactaaattgcccgataccgaagacccggaatatgtggatcgggtcaatgatgacaaccctgagacgagatctgctcaacgaaaggttgaagaacgcaatgataaactgcggcgctatattccgattatttcggtgtccgtcgtcgttttaatcattttgattgccatttgggtggctgcggccagaagtacccgaaacactgccaaaacgcaaattgagaccagcaaagtttccgtttccggcgacaaatcatccagttccaaggcttccagttcgaagaaagccaagacgactaagaaggccaaggggattacctttaagaaggttactgcttctggcagcaatctgacctaccgattcaccggaacttccggtacaacgccactgaagatttccgtaaccggttccgggagtgcctggacgtcggtttctgcagatggcacttctttatggcaagcttcattaaccagtggtaattcacatacaatctcgcttccaagctcgaccaataccgttacgattaatactggcaacgctgaagcgacccggattaccgtgggcggcaagaagttgacgttggcggcaccgttaaatggcggttcaactcaggtgagagttgtcacattgcagtttggcaagccaagttcatctgcttcaaccagctctagttcaagtagtgccacgacgggtgcctcaactaccagtagcacaaccgggacgaccggcaccactggaacgtcctcaacgactggtactgacacaaccggcaacacgaatgcaacaactggcagcactggtacgaataataataccggtaccaccaatggctattagtcagctggaggtttaacatgaatttaccgaataaattaacactatttcgaatcatcctgattccgttctttatcctgatcctcgcggtcccaatcttttccggcagcgttgtttgggcgggaaccacgatcagtatgaccagattgtgggcgacaattatctttgtggtcgcctctctaaccgatttcttagatggtcagattgccagacgaaatcatttggtaaccaactttggaaagttcgccgatcccttggcagataaaatgctggtaatgacggcatttctgtttttagttggcctgggggatgttccggcatgggtcgccgcgattattgtctgccgtgaattggcggtaaccggactgcggctgatcattgtcgagaacgaaggtcaagtcattgctgcggcctggccgggcaagatcaagacaaccactcaaatgctggcgatcattttactgttcttgaacaacgttttatttgatgcagtcaacattccaatgggcttaattctgttatacatttgcctattcttcacgatttactcaggaattgattactttgtaaaaaatcgctcagtattttcagattcattttaatcacagctgccggagggttcatgaaaatgagtcttccggtatttgtgtcttgttagataaaaatcaagtatttaacgtacttatgaactagagggagcaagtaagatgacattggaagagacattagtaaatgaactattatcccgacacattacaattacagcggctgaaagtttaactgccggtgaatttcagagcactctcggtaatgtgcccggcgtctcagaagtttttgaggggggatttgtcacatactcaaatcaggttaaagaacaactactgcagataccaagtgaagtaattgatgaaaatggtgtcgtgagtgaaccgactgccatttggatggcaaatcaggcccgaagcatcatgaataaagatctgggcgtatcctttaccggagtggccgggccggacacgttggaaggcgatcctgctggcacggtctggattggcattgcctatggaacccaatatacttatgcgaaacagtttcatttcacgggtgatcgaaatcagattcgggccgctgcagtcaaggccggcttggagatggcgttggacatgattcatcgctattaaattaatcgaacttttgttcgcgttttgattgcttttttggataatcattagtatagttagtaagtaaacttttccgttaaggatagtgggaggaatttaatggctgaccaaagaaaagtagctttagataaagccttaaagaatattgaaaaagaatttggtaagggatccatcatgagaatgggcgacaaagccgatactcaaatttccacaattccatctggttcattagcgcttgatgatgcgctgggagtggggggatacccacggggcagaatcgttgaaatctatggacctgaaagttcaggtaagaccactgtggcgcttcatgcggttgccgaagttcaaaagcgcggcggcacagctgcctacattgatgccgaaaacgccctggatccggtttatgcaacccacctgggtgtgaatattgacgatctgttactttcgcaaccagatactggtgaacaaggcctccagattactgacgcattggttaccagtggggcaattgatatcgttgtcattgattcagtcgctgcattggttccccgagctgaaatcgaaggggaaatgggggacgcccacgttggtctgcaggctcgactgatgtcgcaagccctccggaaactttctggaacgatcagtaagaccaagacgattgccattttcattaatcagattcgtgaaaaagttggtgtgatgtttggtaatccggagactacccccggtggtcgtgccttgaagttttatgcgacaattcgactcgaaattcgtcgggctgaacagattaaggacggtaccaacatcattggtaaccgtgtccgcatcaaagtcgttaagaataaggttgcaccgccatttaaacgtgctgaagttgatatcatgtatggcaagggtatatcccaatctggcgaattggttgatatggctgttgaaaaagacattattaacaagtccggctcatggtattcatatggtgaagaaagaattggtcaaggccgtgagaatgccaagacttatcttgaagaacatcaagatatgtatgacgaggtgatgaagaaagtcagggctgcctacgacattcctgatgaaactgactcggacacctctgatgacaaagccagttccgataagaagaccgataaaaaagccgacaaaaaggattccaaaaaggaatcggcaaccggttcttcaaaagaaaccaaaactgatagcatcgatcttgatattggcaagtaattggcactaccaaatgcaaatagatttcgttaatgggcactcagaggagatgcccattttttgtgagttaatcaaggcacagcaggcttttgtgaaacattttaaaagaaaatatggtcactcaaaaatcttgttatatacaaataccaaaaaccgcaacgtaaagatgattgacactagtgttaacaaacattaaaataagaattgtgtcaataatcaaataacatctaattggtttacaaataatcattttttgatgatttggaggtgaaaagccatgaccatggctgggataatcctcgcaatcatcgctataattgttgttggttttgttggtattttaagctttgtaatcggcaagtctgcacaaaagaagatccacgagaaagatcttgactccgccaatgggtcggccaagaacattttgaccgaagctcagaagaaggctgagacggttgtgaaagaagcaactctatcagctcaggagaagaaccaccgttaccgttcatcggttgaaaaagaactgaagactcggcgtgcggagattcaaaaacaagaggatcgtttgctgcagcgagaagaggctcttgatcgtaaagacacggctttcgaacgtcgtgaaagttcgttgaaccgaaaagagcagaagattaatcgtgaacaacagaatttagttacacaacaagaagaagcaaactcacttatcgcaaaacgccaggccgaagttgagaaagttgctgctttaacgcaagaagaagcccgggacctgattttgaaagaaactagcgaaaagttggctgacgaaaaggctcggatggtaaaagaaagttattaccaagcccaaacagaagctgatgaaaatgccaaaaatctgataattgaagctattcaacagagttcagcggacgttgtctcagagacaaccgtttccgttgttagtcttcctaacgaagacatgaagggacgaattattggccgtgagggccgtaacattcggactttcgaaacgttgaccggcattgatttaatcattgacgataccccacaagcagttgtgctgagcggctttgatccgattcggagagaagttgccaaaatgacacttgaaaagttaatcaaggacggtcggattcatccggcacgaattgaagaaatggtcgaaaagagccgtaaagagcttgacgaacgtatccaagaaattggggaagagacgctattcgaccttgggattcattcaatgagcccagatatgatcaaattagttggacaactcaactttaagattgatcatgggcagaacttgctgagtcattcaattgaggtcgccaagttggcgggtgcttttgcagcagaattaggtgaggatgttactttagctaaacgcgcaggattattacacgatatcggtaaagctgccaataatggtgttgagggatcacatgtacaggttggtgttgatttcgccaagaagtatcatgagagtcccgttgtcattgatgctatcaaaggttatgaagaaggccacaatccagaaacaatcatttctgagttggttgctgttgcggaaaagatcgcgatttcgcgtccaggcgcacacagtgaatcacttgaaagctttgttcatcgacttgatagtcttgagaagatcactgacagctttaacgaagtacaaaagagttacgcaattcaagcaggtcgagagatccgtgtgattgcaaagcccgaagatataacggacacacaggcaattgtgcttgcccgtcagatcaaacaaaagattgaaactgagatgaagtatcctggacacattaaagtaacggtgatcagggaagttcgttcagtcgaatacgcaagataaaagatcagagtctctggtcttttttcttttataaatgttagaattattttatattattcagaaagtatcgaggaaaaatacatgcgaattctttttatcggtgacgtggttggcgacaagggtgtttcaatgattggcaattatctgccaagactcaagcaggatctgaaaccccaggtcacaatagtgaacggcgaaaatgcaacttcaatgggtcgcggcatcactttgagtatctataagcaattgatgagtgatggtgtggatgtggtcacgcttggaaaccatgcttggagcaataatgaaattctcgacttcatcgatgatactaaacggctgattcggccgtacaattttcccaagcgaacaacacccggaaaagggtataccatggtcaatgtcaacggcaaacagttggctgtcctgaattttcaagggcgcgtcttcatggacaaccttgacgatccattcgagctggctgacgaactggttgaagagattcgaaagacgaccaattgcatttttatggattttcatgccgaagccaccagcgaaaaattagcaatcgcccgttatttggacggccgaatttcagcggtggtggggacacatacccatgttcaaacaaatgacgcacggattctccaaggcaagacggcctttttaaccgatgccgggatgaccgggccggctgacggcatgttgggcatgcagccggacagtgtgattcaacgcttcttagatcagcgaccagcccgatttaaagttatggaaaccggtcggggaatcatttccggctgcttcgtcgatattgacgataagaccggtcacgcgacccacattgaaaccgtgtcgatgactgatgatcaaatttaattgtgttttataatagtttagacgatactgaaatcgaattcagtgagaatttaaggggactttcagttggcaaaaaaagaattaactccaatgatggtgcaatatcaaaaaatcaaggaccagtatccggatgcttttttgttctaccgtctcggtgatttctacgagatgttcaatgaggatgccatcaagggttcacagttattggaattaactttgacgaaccggagccggaatgcggccaatccggttccaatgtgtggtgtgccccacaaagcggtgcaaaattatattgatattctagtcgaccagggatacaaagtcgcaatctgtgaacaaatggaagatccacgattggctaagggaatggtcaaacgagaagtcattcaattggtgacaccgggtacgcaggtggatgttggcagtgaaaacgccaagtccaataactatctgactgcggtggtggatgatcaaaaaaaccatgagtttgccttctcatacgccgatctttccactggtgaactcaaagttgccaaattaaccacacaggctgaatttgttaacgaactggtttctttacagactaaggaaattgtcgttgatactgatttaccggagtcaattcaagatacgattcaaaagttggggattttgatttcccatcaatcggttctgccggtcaatgcctcagtcagttacttaagccaggacgttgatgacgacttgatgaaacgggttgtcaaactcctgttggattatatccaggcaacccaaaaaagaagcctgcagcatttaaagcgggcagtgatttatgaaccctcagattttttggaactcgaccacaattctcaatacaatttggaattaatccgcaatattcgcacaggtaaaaaagccggcactttattgtggctgcttgaccaaaccaaaactgcgatgggcggccgaaaactcaaacaatggattgagcggcctttggtgaaccgcaaactgattaatcaacgccatgatgcagttgccgtgttactggatcactatttcgaacgaaatcaactccaagacgagttaatcaaggtttacgatctggaacgattggcaggtcggatttccttcggcagtgtcaatggccgtgatttgattcaactcaaggcttcgctcaagcaggtcccgaagattaaatatattttggagcaaatcgccgacaagagttttgaggatatgctcaaaaatctggttccattggatgatgtcgtcgacgaaattgattctgcgatcgtcgaggaaccgccaatttcagttactgatggtggggtgattaaggatggctacaatcaacagctggacacttaccgggacgctaccaataacggtcaaaaatggttggctgaactggaagcgaaagaacgtaaaattaccggcattaataacttgaaagttggttttaatcacgtttttggttactatattgaagtcaccaaggtcaacttggacaagattcctgcaaaccgttatcagcgcaaacaaaccctggccaacgccgagcgattctcgacgccggagctgaaggaaaaagaagcgttgattttagaggcccaggaacaaagtaaaactttggaatacaagctattcgttaagatccgtgatgacattaaaaaatccatcaaacgaattcaggatttagcagatgccgtagcgtcaatcgatgtcttacagagctttgccgccgtcagcgaggagtaccgatttgttcgaccaacgcttacgacgcagcatgtggttgaagtcaaagacggtcgccacccagttgtcgaaaaggttttgggccaccagcaatacgtcccaaatgacgttaatctgggcgaagataccagcatcttactgattaccggtcccaacatgtctggtaaaagtacctatatgcgtcaaatggcactatgcgtcatcatgaaccaaatggggtgttttgtgcctgccaaacatgccaaactgccggtgtttgacaaaattttcactagaattggggccgctgatgatttaatctcgggccaaagtacgttcatggtcgaaatgaaagaagccaacgatgccattgagaatgccactcccaacagtttgattttgtttgatgaaattggtcgggggactgcaacctacgatgggatggcgttggcccaagcaattatcgaatatgttcataacaacattggtgctaaaaccctgttttcaacccattaccatgaattaactgttttggatgagtctctcaaacgcctgcaaaatgtccatgtcggcgcgactgaatccaatggcgaactggtctttttgcataagattcagccgggccctgccgataaatcatacggaatccatgtggctaaattggcaggtctgccagaagggttattacaccgtgctaacgacattttaaccaaccttgagcaacaggccgataaagagcatcaaacggcctccgcaccaaagcaggcgcctcagcaggcagctgagcagcagacgtctttatttccccttgagcaaattgatgataaacaagccgaagttgtgtcacaattaaagaaattggacttgatggggaagactcccatgcaagtgatgaatcaagtttacaaatggcagcagaagataaacggagactaaggtgattgatttgaatgaaattcataagctaccaacaatcctttccaaccagattgccgccggtgaagttgttgaacgaccggcatcagtggttaaggaattagttgaaaattcaatagatgccaagagttcggaaatcgatgtcaccgttgaaaattcgggcttgaagttgatcaaagttgtcgatgacggcaacggaattgacagctctcaagttcagacggcctttttacgacatgcgaccagcaaaatttctgagcaacgggatttgttccgcgttcggacactcgggttccgtggcgaggcactccccagtatcagttccgtcgctaacgttcggatgaagacgtcaaccggttcgattggaacggaagttgaatacaaaggcggcaagcttgtcactcaaaaggcttctgaatcacggaaagggaccactgttgaagtggcatcactgttctataacacgccggctcgtttgaagtatttaagttcaccgaatacagagctttccaaaatatcagacattgtcaaccgcttggcattgagtcatcctgagattgctttttcatttatcagtaacggccgtgaattgttaagaacttccggacgtggggatttacgccaggttttgggcgcaatttatggtgtcaagacggtttcaaagatggcggcaattaagggaaatgatttggacatcaaagtcagtgggtatgtgagtttaccggaattgacccgttcaagtcgaaactatatttcactgattttaaacggacgctttattcgcaactttccgttaaccaaagcggtgattgcgggctatggttccaaattaatgattgggcggtttccaattgccgtaatcaacattgacgccgatcccgctttgatcgatgtcaatgttcatccaaccaagcaggaagttcggattagtgacgaaccgatgattggtaaattaattgccaatgccatttacgacatgctaagagacaagcagctgattccagatgcaaccagggatttcaaacagccggttcaagctgcaccaagacagtttgatgtttcgactgccactcaggctcaaacaaatccaccgctgtttgccgtcgacacaccaacgacgccttcaatttcccaacctgaagtaacgccggtggtggtcaaaaccagagacgaccttgccagctcacaagttgctcaatttgatgactttcttaaaaatgagccgagtggcttgcctgcatttgaaggaacccagccaaaaacgattgacaatcaccagccgagtgccaagcctgagcagtctgaactggtagtggaaaccggttttccgcatctggactacattggtcaaattcatggcacctatctggtggctgaaacagccgataatatgtatctggtggatcaacacgcagctcaagaacggattaactatgagttttaccgtaagcaaattggcgaagtttctgatgaccaacagaaattattggtgccaattgtgctcgattactcaacctcggatttcttgatgattagcgaccgtttggacctgctggacaaacttggaattcatttggagccgtttggacagaacagtttcatcgtccgtgagcacccaatgtggtttaaggccgggcaggaagaagacaccattaaagaaatgattgactggattttatccgatcataaaatttccgtggccgccttccgcgaaaaaacggccatcatgatgagctgtaagcgggccattaaggcgaaccatcatcttgatgagctccaggcaaaggcgttactgaaacggctgcctgagtgcgagaatccatataactgcccccatggccggccggttctggtgaaatttaccaatgaggatattgaaaaaatgttcaaacggattcaagacccccatcatacagaccaagaaatcatctagattgttgcccagtaccgagtgagatatggtacaatttattggcaaacatacgttttagtgaagaggagaagttgatgtttgaatttttggaagggacggttgttgatatcacacccacccacatcgttttattagtgggcggcgttggttatttgatcaataccgcagacccgtaccgttttaatgttgatgagaaaaaagtcatcagagtctatatttatcagtcagtgagcgatacggctatcttgctgtttggctttgcgaccattgaagacaagcagatctttgaaaagttgatttcggtttccgggattggccccaaaagcgctttggcaattttggccggcaacgaccgggatggattgatcaccgcaattaataatgaagacgtcaagtttttgacgaagttccccggagttggtaagaaaactgcccgccagattattttggatatgcaggggaagctcgacgacattgcaactaatggtgtttcgctggcccaaccgcttggcagtaacgaaaagtctcctgaattggccgatgcgttatcggcattggaggcgctgggttatggtgccaaacagattgccgccatcgagccggatttagttaagcaagctgatttgtcaaccgatgaatacttaagtttaggattgaaactgttaatgcattagggatgaggagatgatccattggccaatgaaaaagatgatcgattggtttcaccagagaatgtggatgccgatgagaacagcattgaaaaatcgcttcgtccccgagttttaagtgagtacattgggcaggatgacgttaaaaacgagttaagagtctatatcaaggctgctaagcaacgtgaggagtcactagaccacgtgctgctttatgggcctcctggacttggaaaaacaacgttggcgatggtgattgccaatgaaatgggcgttaatattagaacgaccagcggtcctgccattgataagcctggggatctattgtctttactcaatgaacttcagcctggtgatgtcttgttcatcgacgaaattcatcgactgcccaaggtggttgaagaaatgctttattcagccatggaggacttttttgtcgatattatcgttgggcagggttcaggcgcccacccaattcatttcccactgccgccattcactctgattggtgccacgacccaagcaggaatgctgtcggcaccactgcgtgatcggtttggaattgtagagcacatgaattattacaatgcgacggatttggaggatattgttcgccgaactgcggatatttttcaaattgatattgaggactccggtgcccatgagattgctttgcggtcccgaggaacacctcgagtcgccaatcgcttgttaaaacgggttcgagattttgctcaggtatctgacaaagaccaagttgatttgtcaattgtcagatacgcgttggcaaagttaaaagtcgacgacttagggttggatgcaaccgacctgaaactgttgacgacaatgatcaagtattatgacggtggaccagttggcttaaacaccctggccgccaatattggcgaagaaaccgacacgattgccgagatgtatgagccttatctgctccagatcggtttaatcaaacggacagccagaggaagaattgtgactcccaagggatacgctcatttgagttatccaatgccacctcaggacgaaaggaattagaatcttgaaaacaaattatacccttgaagactttgattatgatctgccacatgaattgattgcccaaacgccgattaaagatcgcgatgaatcacgactgctggtgttggataaagaaagcggtgagatgcaggaccgtcatttttacaacatcattgattatttgaatcccggggatgccctggtgatgaatgactcaaaggtcatgcccgctcgaatatacggtgtcaaagccgataccggcggccacatggaagtgttgctgcttcataatattgagggcgaccgttgggagactttgatgaagccagccaaaaaagccaaggtcggcacggttatcaattttggtgatggccagcttaaagccgttgtaaccaaggaattggatcacgggggccgggaaatcgaatttcaatacgatggcatttttatcgaaattctggagcggctcggtgagacacccttaccgccgtacatcaaagaaaaattagatgatcctgatcgttatcaaacggtttacgccaaagaaatgggctcggctgccgctcccacggctggtttacactggaccaaagatctacttaaaaaagtcgaagataagggcgttcatttggtttatctgacgcttcatgtcggcttggggacatttcgcccagttgatgaggaaaatattgaagatcacaaaatgcacagcgaattttaccgtttatcagaccaggcagcggccacgttgaatgctgtccgggataatagcggaaaaattgtggcaaccggaactacgtcaattcgaacgctggaaacggtcggaactaagtttgacggtcaaattcgccctgactccggctggacggatatttttatcaaaccgggataccagtggcgggtggttgattcatttatcactaatttccatctgcctaaatcaactttggtgatgctggtggcatcgtttaccggacgggaaaatattctgaacgcatatcagcatgcaattgacgagaaatatcgcttctttagttttggcgatgcaatgtacattcactaggaggattattatatgcaaccagcgataagttatcgcttgattaaaaaggagaagcacaccggggcccgtttgggagaaatcaccacgcctcacggaactttcaaaacgccgatgtttatgccggttggcacccaggcaaccgtgaaaactctggctccggaagaattggagcaaatggggtcgacgattattttggcgaacacctatcatttatggttgagacccggagaagacatcgtcaaagaggccggcggtctgcataaattcatgaattggcacaaggggattttgacagattccggtggctttcaagtcttttcactggctaaaaatcgtgatattaccgaagaaggcgtgaccttcaaaaatgaaattaatggttcaaaaatgtttctgtctcccgaaaaggcgattcagattgaaaatgatttgggtcctgatatcatgatgagccttgatgaatgtccaccattttttgagtcgtatgattacgtcaaaaagtcagttgaacggaccagtcgctgggcagaacgtggactgaaagctcaccgaaatcctgactggcaggggttgtttgggattgtccaaggcgccggctttgaagatcttcgcaaacaatctgcccgcgatttggtcagcctggattttccggggtattcgattggcggattgtcagtaggagaatccaaacaggaaatgaatcgcatcctggaatccaccagtccacttttacctgagaataagccgcgttatctgatgggcgttggagcaaccgattcgctgattgacggtgtgattcggggcattgacatgttcgattgtgttctgccgactcgaattgcccgtaacggaacggtgatgacgtcccatggccgactggttgttaagaatgccaagtatgcccgtgacttcacaccgttggatgatcattgtgactgttacacctgccgcaactacacccgggcatacatccgtcatctgatgaagaccgacgaatcttttgggatgcggttgtgcagttaccacaacctttattatttaatccatttgatgaaacgggttcaacaggcaattatggacgataatctgttggacttgcgggcagaagtttttgaacagtatggttataacaaaccaaatccaaaaaacttttaggtgtagactattcagggcttatttggtaaagtattactatggaaagtgtgggtgaaaaattttgaatcaatcttattactcaattttaatgattgttgtcttgtttacggtgatgtacttcttaatgatccgtcctcaaagaaagcaacaacaaaagcgtcgggatcaactttcaaagatcaaggaaggcgaccaagtgattacgattggccggctccatggtgtcgttgacgaaatcaacgaagccgaaaaaaccgtgactttggattgtgatggtatctatttggtatttgatctgagcgcaattgcttcggttaagcagcctgctgttgctgcgcctgcagcaaacaacgatacaactactactgcaaatgatgatcacaaagatgatgctgcttcatcaaagggcgatcaggatgctaccgaagattctgataccaaagatgaaacaaagtcggaagacaaatagtttgacgaagtcggttgggaagttgatttttatgaatcccgaccatttttttacccggcaaagaacatacgtttgattggggtgatctcagtgaaaacatcggctagaaacatcatccatgtggatatggatgccttttatgcgtcgattgaggaacgcaaagaccccactctcaagtctcaacccctgattgttgccaaggatccgcgcaaaaccggcggcaggggagtggttgcaacggctaactataaggcccgtcaattcggggtgcattccgcaatgagtgccatgaaggcgctggaactttgtccccaggcggtttttcggttctctggatttgatctttaccgctcagtttccaatcaaatccacgagatttttcatgagtacacggaagtgattgagtacgttgccttggatgaggcttatttggatgtcactcataataaaaaacatctcacagacccgattcaagttgcccgaatgatccaaaatgaaatttgggatgccacccacttaacctgttccgtgggagtatcttacaataagtttctcgccaaagaagcctctgattacgccaaaccagtgggcattacagtgattggacagcgagatgcattagaatttttaagccgtttgccaattgaaaagttccgcggcgtcgggaaaaagaccgttcccaagatgcatgaattaaatatcaataacggtcaggatctgattcagtggtcgcagatggatttgatcaagcactttggtaaatttggttacgttctctatcagcgcgctcgaggcattgacgatcggccagttgagtatcagcgggttcgaaaatcgattggcaaggagcggacatttggcccggcgattgacacacaaaccgaagtcgatgacgaactccagcgaattgctgcgatggtggtcaaggcaatggatgacaaaaagaagcacggtaaaacattggttcttaagatccggtatgccgacttttcaacgtttaccaagcgggtcacgatggataactatcttaaaaatagccccgaagaatactttacccttgccaacgatttactggtcgatatgccggatatttcaaaaggggtgcgcctgttgggaatcaccattaccaacctggatgatttaacttacgagaacattgttcttcacctgtttgattaattcaccaccccaacggtttatcttattcacaaagtaatgtatacttaagtgttcgacaataaagttatggagcaaataaaatgtcaattcaagatcaaatattaagtgaaatcaaaaaatttaaaaccattattattcatcgtcacaaacggccggatccagatgcgatcggatcacagatgggactggctcaactaattaaggggtcatttcctgataagacagtcctgtgtgctggtaaacaatatgatagttttgcctggttgggaaccaccgatgaaattgccgacgagcaatataaagatgctttggtgatcgttgttgatactgccaatcagccgcgtgtcgatgacgaacgttatacgacgggaaaagaattgattaagattgatcatcacccaaacgacgatcagtttggtcacattatgtgggttgagccggattcatcaagtacatctgagctgatttatgatttttatgatgccaatcgtgatcaattaactttgcccgatgaagttgcccgactcctttatgccgggatcgtcggtgatactggcagatttatgtatccttccacgtcgccacatactttggcagttgcttcaaaacttgctgaatatcatttctcaaccagtgaagtcaacaaaatagaagacgagatcgacattccactggcacggctgtccgcttatgtttatgagaacctgaatattcttgatagcggtgccgcttatctggttttgtccaataaagtattagagcccttcaagttaggggacgaaagtacttctgccgtcgtgccattacctggcaagatcaaacaagtggtttcctgggcaattttcgtcgaacaaaaagatggctcctttcggattcggttgcgctctaaaggaccagaaatcaacgaattggccaagcagtatggcggcggtggccatccactcgcaagtggtgctgttgtcgaagatgaagcccacatcaaggaatttgtgagcgatttgaatgatttagtcgccaaaaacaagtaggagattatatgagtaatttttcagagtttaatttaaagccattcttattggatgccgttaaggagctgaacttcagccacccgacacccgtccaggaaaaggtgatgcccgttatcatgcagggaagagatgtcgtgggccaatccgctactggtagtggtaagacccatgcttttctgctgccgatttttaaccagcttgatcccgcaaaagatgaggttcaagcggtgatcaccacccccagccgggaattagcctatcagatcattgatgccgctaagcagttggctaagcactcaccagaaccaatttctaccggtgcctacattggtggaactgacaaggcgcgtcaggaaaaaaagattcaacatgagcagcctcaactggttgtcggcactccgggtcggatttgggatctgatccaaaacggtggactggatgttcacacggcttctcagttagttatcgacgaggcagatatgactctggacatgggattcttggatgtggttgataacatcgctgccagtttcgggaaacatgttcagatgatggttttctcggcaacgatcccacaaaaaatcaacgtctttttgaagaaatatatggttaatccttttatcgaagagattccggtgtcaacgattatcagtccgacgatcgataattggttgatttcgacgaaggggcaggacaaaaatcaactcatttataaattgctgaccattggggaaccttatttggtcctgatttttgccaatacccgcaaacgagtcgaggagttaaccgagtatttgaagggccagggattgaaagttgcgatgattcatggcggtctcaagcctcgtgaacgtaagcaaatcatgaagcgggtcaaaaacctcgaatttcaattcgttgtcgcaactgatttagctgctcgagggattgatattgaaggggtatcggatgttatcaatgatgatattcccaccgaggatttggaatttttcatccatcgtgttggtagaaccggccgaaacgggatgtccgggacttcgattacgttgtattctcctgatgaggaaaaagaagttgaagaacttgaagatatggggattcatttcaagccgaaagcccttaagaacggcgaaattgtggattcttatgatcgaaaccgtcgaaagactcatcgaaagaaacacgataagctggatccaacgatgattggcatgatcaagaagaaaaagaagaagatcaagccgggctacaaacggcgaattaaaaataccattgcccgaaaggacgagatggatcgtcgggttgctaaacgtgaggaagcacgggccaaacggaaacaacgtaagaatagttcttcacggtatcaataggtctgtattgacaccatattcacaaaaaagtatactttgagatgtgttaagaacatgccgtttaattttttgtttcagagacgttttggttggtgagaaaagcgacgaaaattaaacggtgctctcttaaaagttaaattatcaaacgcaactctgcgttatagagatcaagtggttaacgataaacatcgttgcaatcagagtggtaccgcgtcaatgggcgtctctgtgagcaacggtgttttaattttgtcaaaggagaagagaacatgaaacagttaagcagtggtcaaatcagacagatgtacctcgattttttccaggaaaagggccataccattgaaccaagtgcctcactcattccagtcgatgacccaactttgctttggatcaattcgggtgttgccactatgaaaaagtattttgacggttcagttgtcccgaaaaacccacgaatgaccagttcacaaaagagtattcgaaccaacgatattgaaaacgtcggtaaaacaccccggcaccataccttatttgaaatgttagggaacttttcagttggtgactatttcaaaaaagaagccattacctgggcctatgaactgttaacttcacccaagtggttcggctgggatcccgataagctttatatgacggtttacccgaaagataaagatgccaaaatgtattgggaaaaagtgggcgttgcgcctgatcatatcattgaaattgaggataacttctgggatattggccagggaccatccggccccgattcagaaatcttctatgatcgcggcaaggactttgacaatctagcccctgatgacccggaaaattaccccggtggtgaaaacgaccgctggctggaagtttggaacattgtgttctcacaattcaatcacaccccacaagatacttatgaaccacttcctcgaaaaaacattgataccggaatgggtcttgaacgagtggtttcaattttccaacatgcccgaaccaacttcgaaaccgacctctttttgccgatgattcgcaagactgaagaattaagtgacaataagaaatacgataccaacaagaaggataacgaagccttcagaattattgccgatcatgcccgggcaatcacggttgctatcggcgatggcgcattgccttccaacgtcggccgcggctacgttatccgtcgcttgattcgaagagcaatcgttaacggtcagcggcttggaatcaacgaagctttcttatacaaattggttccagttgtcggccagactttggaatcatattatcccgatgttcttaagcaaaaggattatattgccaaagttgtccgttcagaagaagatcggtttaacgaaacgctgactgacggcttgaaactgttcaatcaagtggtaaaagacgccaaagcaaatcatcaaacgaccatcgatggcccaactgccttcaaactctacgatacgtatggtttcccagttgagttgactgaagaagaggccaatgatgccggcttatccgttgacaagccaggctttgaggttgaaatgcaaaaacaaaaagatcgtgcccgaaaggccagaagtggtgccaagtcaatgggtgttcaacgggatctcttaattgaaatcaaggatccaagcgagtacgttggctacgataccttggatgtcgatcacgccgagcttttggaaattgtcgagaacgaaaaactggtcgatcattcaaagggtggctctgttgaagtgatctttgacaaaacaccattctacgcggaaatgggcggccaagttgctgaccggggagttgtccttgatgaagagggagacaaggttgccgatgtcgttgacgtccagcatgcacccaatggtcagaacctgcacacattaaaaactcaggaacccctcgaaaagggcaagacctatcacttgattgttgacaaattattccacagtcgcgttgagaagaatcacacagcaacccatttgttggaccaatcattgcgaaatgttttgggtggacacacccaacaagctggttcactcgttgaacctaactatttgcgatttgattttaaccactttggccaggttacggatgaagatttacagaaggttgaagatatggttaaccgccaaatcttcaatgaaatcgatgtcaacactgttgtcacggatcctaagaccggtaaaaagatgggtgctattgccttatttagtgaaaagtatggcgataaagtacgtgttgtcagcattggcgacttctcagttgaattctgtggcggaactcatgttaacaatacccgcgacattggcttattcaagattgtctctgaatccggagttggggctggtgtccgccgaattgaagcggtcacagccaaagatgctttcaagttgctgaacgatcatgaaaaggaactgaaacaaattgccggcgacttgaaagtcacccaaattaaagacacacccaaacgggttgaccaactgctgggcgaaattaaggatcttacccaaaaacaacagtcactggaagccaaattggctggacaacaggctcaaaatgtttttgccgacaagaaaactgccggtaagtattccattatcaccggaatcatcaaagatgccggaatggatcagctgcgccaattagctgatacttggcgctctaagcatttgtctgacgtcttggttcttggaaccggcagcggcgacaaagctaacttgattgtcgcagtggcagatgaacagatcaaggcgggcattaaggctggtgatctgatcaaatcgatcgcgggcaatattaaaggcggcggcggcggtcgtccaaacatggctcaggctggtggcaaagatcctgctggccttgataaagcgatgagcgcagcggttgattggttggcaaataaataattattacaccacggttacatgtcggttacattggcttacttgattgtagtttcacttataatcagttaaaattaatacaaatgaccttaagtcatagaggtgaattgtatgagttcgttagataaaaccatgttttttaattttaatgaagatcagccaaaagacgtccgcgaaacattgttgactgtgtatgcagcactggaagaaaagggttacaatccatataatcagattgttgggtacttgatttctggcgatccagcatacattccacgtaaccttgatgcgcgaaatcttatccgccgacatgaacgtgatgaaataatcgaagagttagttcgtttctatttggataatcatccaaccgaaacgaaaaaaggtaaaaaatgagattaatgggtttagatgttggttcaaagaccgtcggggttgctgttagcgaccagttgggctggacctcacaaggggttgaaataattcgaatcgacgaggacaacaaggaatttggtttagatcgggtttccgagttggttaaaaagtaccaagttgatggatttgtcgtcggccttcccaaaaacatgaacaattctttaggcccccgggctgaagcttcgcaacagtatggcaaacgacttgaagacaagtttaacttgccagttgattttgaagatgaacgattaacgactgttgaggctcagcggatgttgacagaagaagcagatgtttccagagccaagcgcaaaaaagtgatcgataagctggccgctggcttgatacttcagaattatttggaccgcaatggtaaattaactaaaatatagcgaggtaaacaattatggcagaccaagaaccagtacaacaacaaattacattagtcgacgaaaacggcgatgaaactttatacgacgtattattcacttttaaatcagaggactttgatcggtcgtacattctgatttatccagatggcaaaggtgaagatgaagaagtcgaaattcaagcttatgcactgccaaagggtgatgatccaagtgaccctcaaggtggagaacttcaagcaattgaaactgacaaagaatgggatatgatcgaatcagttttgaacaccttcttgggtaaagatggcgacgatcaggatgatgacagcaacgacaatcaataattaaagattgtccctattgcgaaaggattgaggcgaagcatcgttgagtctcagtcctttttaattgaaagaatttaggatgtgatgtaatgtctagtaacgaaaaacgtcgcttcaaaacaaccattgatggcaaggattacgtgcttgtcggtaagggatcggttgatcatatgcaggcggtgtccgatttattaaatgagcagctcaagcaacttcatgaggcgatgccaactgccactgatgagcagcgggcaatcctaattgcctttaatgcaatctccaaacaatttgatgttgaggaaaaagcacacagtaaagaggttcattagatgatttttacaattgggatcattctgattttaatatttggctttttccgcggccttcatcgaggtttcgtgaatgaagtcttaagtctgattggctttttggcggcaaccatcgtcagtatcgttggaaccagtccaattgctgactttattaatcaggcaatttttaaaaacggcggcaatcaaactgctgagttgattatcaaatgggtgatctttgccttcctttttgggtttgtttggcggattgttcgtttgctgagtgatctattatctccgatcacccgcctgccattattacatcaattgaacgcactactgggtgcagccgcagatcttctcatcaagtatttgttcattttcatcttgctgaactttctgctgatgttccctgatcagagcattcaagaacagtaccaacaatttgacgtttcccagtggattgtgaaaaaaacaccgattctctcagataaaatgattcagatttggaatcaacattctagtgaggttaatgtatgaacgaaaaagttttagaaacattagagtatggaaaaatcaaggagcagctggccaaatatctgacgaccgaccgtggccgacaaattgtcgatttattgacacccagtccttcctttgaaaccgtttctcaacgcttggcacagacggccgatggggctgacattgtccgcttaaagggagaaattccgattccaaaactcgcagatattgcaccgtatatgaaacgcctgcggattgaaaatgcgtcattaagcggaactgagctgtctcatatcaccaaattactacgcgctgtgcaggtcgtcactgaattttttaggggcttggcggctgaagaagtgactttaaaatccgttccctcaattgtcgatcggctcacattgatgcctgaagtgaccaaacgaatggtggcttcggttgatgaagacggccgcattctggatggcgcttcttcgcaattacgttcaattcgccggaccattgcggccactcaaagtaatattcgttcgaaaatggggaagtttattaagggatcggatgccaaatacctttctgagccgattattaccgttcgtgacggcaggtttgtcctgccaatcaaggccgaatataagcagcgatttggcggcatcattcatgatcaaagtgcctctggccaaacgttgtatgtggaaccaaacaacgttgtcgaaatgaacaatcaattgcgtcgggatcagcttgctgaaagagctgaagttcggcggattttggcagagttaaccaatttaattcgcccgcatcgtgacgagttgttggccaacatggatttggttggccaattggactttgtgaatgccaaagccaaatttgctcatgccactggtagtgtgatgcccaaagtatcaccgaaaaatgttattaatctcagaaaggctcgccatccgttaattcccagagatcaagtcgttgccaacgacattgaacttggcgatcagtacaatacgattattgtgaccgggccgaataccggtggtaaaacaattaccattaaaactgtcggcctcctgcagttaatggggcagtcaggcctgtttattactgccaatgaagactcccagattggtgtgtttgataacgtctttgccgatattggcgatgagcagtcaattgaagccaatctgagtaccttttcatcacacatggacaatatcatcagcattctaaaacagaccagtaaagacagcttggtcttgctggatgaacttggtgccggtaccgaccccaaagaaggggccgcactggcaatggcgattattgatgcctttcatcaaattggcggcgaactgattgccacgacccattatcctgaattaaaggcgtttgcttacaaccggcaggggattatcaatgcatccatggagtttgatgttgagacactccagccaacttatcgatttttactgggaattcccggtcaaagtaacgccttgaacattgccagcaaacttgggatgccagcggccattattgaccaggcacgggcgtttaccgactccgagaaccaagatatcaataatatgattgaagagctgacagcgcaaactaagcgggctcacgatgaagctgatgaattagatcaacaactgaaagaatcaacccggcttcagcatgacctgcaagacaagtttaccaagtacgaaagtcagaaggaacggctcgtcgaacaggctaagcaacaggctaatcaagtggtcgaagaggctaagaagaaggccgaccgaattattgatgatctgcatcaaaagcaggcccaggtcggtaaagttgccgttaaggaaaacgagctgattgatgccaaaggggcgctcaatcaattggaatctgctccgagtctgacaaagaataaggttttaagaaaagaaaaggccaagcacgatttccatcccggcgacgatgttttggtcaaatcttatggtcaacaggggacgttgctgaggaaggataagaaccatacttgggacgtccaaatcggcattttgaagatgcagattgaagaatctgatttggaaaaggcaactccagccaaacaagataagaatcagtatcagacccacgtgtcccggaccaggtcgactgggatgtcaccgaccttggatctgcgcggtcaccgatacgaagaagcaatgacagaagtcgatcgctacattgattcggccctacttgccggctacccttcagtgacaattattcacggcaagggaaccggggcgcttcgtaaaggggtcaccgaatatttgaaacgaaacccacgggtaaagagttttggctattctgcaccgaatgctggtggggatggttcaacggttgtgaagttaaaataaaaatgattgtgtgcaatctgtttgctttttgctaaaaaattgttagtattaaactattaaaggattggagtgttttaatatgcttaaagaaactacggatcaaacttttgaaaaagacactgccgaaggtgtcaccttaaccgatgtttgggcaacttggtgtggcccttgtcggatgcagacacctgtcatcgaagagctggcagaagaaatggataatgttaagttcactaaaatggacgccgacaaaaacccggaaactttatccaaattcggtatcatgagtatcccaaccttgttggttaaaaaagacggcaaagtcgttgataccatcgttgggtatcacccaaaggcccaagttaaaaaagtgcttgatcaatatgccggctagtctttagaatgacttcggtgtctcaagcggtttgacagtcaaaaagcccaccgcaaaaccaaatcaggttttgtggtgggctttttgattccaatgagttaatcatcaggcttggaattgtcatcgggatcgggttgaacgatttcaaatatagcagaagcttcttgaccatcagttggcttgtcagggctcaaataggtgcttaaaagcacaaatcccttattaacattggccttttcgagctcagcttcggcttgttggttaagaatatactgacagctttgagcgatgaatccggattccagataaaaatcaggatcatcaaatgcgttgagacgctgggcgacgatcttgccgcttagctgccagctgatctggttaccagagcgtttaagcagctttaggtcgccaaatttaaattgtttgaaaaaggtttccaaatcttcataggttgccagacgatgatttcttgccagatgcttgccggcccaataggaaatttcgtggacgtctttgcctaaaatctcaggaatcagtgaatcgcgaattaattcctggcccagtaggtctctcattgtatcgtcagtcataaaatgcttgtatacttcgttatccattttttaatctccatcaatgcaaaatgtaataaataaattatacaataaaatcattaatcttgttttgtaagttgaagtaaagattcttttgcaagataataatgttattgagacaaaggaagaaggaattctgttggataatcggccgattggcgttatggactcgggggtcggcgggcttaccgtcttaaaggaaatcaccaaaatcctcccgaatgaatcgtacatctttattggcgatcaggccaatttaccgtacgggcaaaagagttctgaaaccgtcagaaaactcacaaaaagaattgcagactatctggttgaacaaaatatcaaaatgtttgtaattgcctgtaacacagccactgctgcggcatatgaatatttaaagaaaattttaccgattccggttatcggcgtaatcgaaccgggtgcccaaatggccgttgaagcctccaaatccggggagattggtgtgattgccaccaacggcaccgtccgctccggagattatcagcgattgatcaaacaagccaaccgatcagcagttgtgtcatcgttaggctgtccggaatttgtcacgatggtcgaagaggggcttgccggaaccgttgaagctcaggttgccgtgaacaaccgactggcttggtttatggataaaccgattgatactttggtcatgggctgcacccattttccaattttaaaaaatgaaattcaaaatgtgatgggcaatgccgtcacgttgattgacccgggagtcgcaactgctcagcaagtcaaggcaaagttagcagctcatgatggttttgccctcgcacaaaaacagcgtgttcgaagattttacaccaccgggaacccggcggatttcgccaaagttgccgacaagttactgggaacaccgattagtgccgttaagttagatatttaaaggagtttgataacgtgaaaagacccgaatcgattgtgattgcctcacaaaacgctcataaaatcattgagtttgaggatgcttttaaaccaaccggaatcacgattaaatcactgaagcattttgaaaatgtgccgacgatcgctgaaaccggcacgacatttgaagaaaatgcgaccctcaaggccaccggcatcatgaactttacgcatcaagcggtgatcgctgatgattccggcctggtggttaaagcactcaacggccaacccggtgtccactcagcccgttatgcaggtgatcacgatgatgacgtcaacaacgataagcttttgaaggaaatgcaaaacaaaacggatcggacggcttactttgaatctgttctggtctatttaacgcctgagggtgacaaggtggttgccagcggtcgaatcgacggcgaaattttacgtgaacgccgtgggaataacgattttggctatgatccattattctatgtgcccagccagcagcgaacactcgccgagatgagcacccatgataaaaatctgattagccatcggggcaatgccatccgcaacctgatccgtaaattgttggggttgtgggactcatgaaaattgttgttgttagtgatagtcatggagatcgcgccattatccaagaattggtgaacaaatacgccggtcaagtggatgccattttccattgcggcgattctgaattactagcggacgatccattagtttctcaactgcggattgtccaggggaatatggactttgccgaatttcccgaccacctggttcaagaaattagcggcaaacgaatcctcttgactcatgggcatcatcaaaatgtgaatggtggcctgcttaatttggaattatatgcgcggagcttatccgccgatatcgtcctttttgggcatactcatcaattaggagctgtttttgacgatcagatgctgtttgtgaatcctggaagcattgcctatccacgtgggcaatacgccgggttgggcggtacctatgccattatcagcatgaatcaacgtaattacaccgttcaatattacaaccgccaatttgaaccggtggcgaatttggaacttcgttttccgttctaaccaaaaaggagtctaggattacatgatcgataaaccaattgagaccgtgatgcgtgaaagtcaccgggatattttaatccccgctgatttggtcgcaactgtcaatcaagacaatgatctccaacacgtcttcatggttttgacgaaagttaaatacgcaaaaattcccgtgttagataacgataaccatttcatgggactggtttctttacccatgattactgaactcatgatgcaggataccggcattaccagtcgaccgcttgagtcagtgaaagttaagcaaatcatgcaaaaggatgtcccaacgatttacgagcgggataacctggaagccattctcaggtatttggtggatgaaaactttctggtctacgttgattctgaaaatcactttaaaggaatcattacccgtcgggaactatttaaagaaattaattatttggctcacaactttaataaacactacatcgctttgccggtgtataatcacaaatccaaaaacgaaaccaagcacgccaagattcaaggctccaagggtctgattaatcgataatccattgggtgaatatcgttgatggttacaaaattgaattaagtcaaaaaacgagattactgacaaaatttgccggcaatctcgtttttctaagaattggtcactttattcaaacatcagttggcttgtccatttaccattgttgggctcgccggcagttgaatcccggcttcattaattgcagctagatagaaggccaaaaagttatgggcaacttcgtattggctgccgttttttgtggtgatatttacctgaacgaccagtttgccgttggggaggctaatggtgccaagaatcttgggatctccgataatatccggatagtgggggatctgttcttcattgacctggcggataatttgggtgactttatcaactggcgtttgtgggaaaatgccaacttgaatcatcgccgtcatattgtttcgagacatgttggcaatggtggtgatggttcggttggggatgaaattcaacgtgccgtcgtcgccgacaacctgcgtggttctcagtccgactgcggttaccgttcctctaatcgtgccaatctggacgtactcgccaacttcaatttccttttcaagaagaatgaaaaagccactgacaatgtcagtcacaaatccttgggcaccaaggccaattgccaagctgaagatcccagctgaggcgaccagggttccaactggcaccccaaccgttgagagaatggagtaaatccagaagaaccataggcagtagttcaaaatgttcagcgtcagggtgtgaaaggtcttgatccgtttttctgccacggtattttgatatttgcgccgatagcgtttgaaaaaatgattaatcagtcctttaccaatccgacgaaagagtaaaaataacagactgaataaaattaataatccgactttttccagaatcgtcatggccagctgatcccagtcaaccatgttgagatatttttgccaattaatggctaaaactgtgaattttaaggtatttatcattgggattcctcgctttgtgtataatatcatcttagcaaattggttctgcaaaagaaaccactcttcgttcattttcattgtcaaaccattgctggaatgctattcttaagtaaatgttgcacaaggaggaagatcaatgactgctggacaaatagccggccttatcgccgcaattgcatttttgcttttggtaatcttcattggcttattcttaatgaaggtaagcagaactatttcagaagtgaaccgcacaattaagacaatgaccagtaatgtggacgtcattgccaaacaaactgataatattatggcaacatccaacgatttactgaaggatgttgatgacaaattgaacattgtcacaccggtctttcaagccgccgctgatttgggtgagagtgtgtcaagtttaaataccgctactcaaaacctcactaaacgggttaaagatactggcaaaaagggtgtttcagcagggctcgccggtaagtttggcaagagtgcctggaacatgtaccgcaatcgacacggttcaaaggatacaactaaataaacaatcgaagggatgatcagaatgggtaaaaaattagcatttggcttattcgctggtgcattgggtgccggtctatatgcagcctaccaaaaattggatgaagcaaagaaggcccaactcaaacgagacgcccgtcaaaaggctgatgagttgcgggatcgggcagttgactacgcgttttacgccaacgatgccgtcagcgacttaaaagatgtgattcatgatgaaatgcaaaataccaaagggactgtcaatgatgccaaaacgcaattcgctgacaaagctaaatcttttggtaccgaccaagcagccgatgatgacgacgctgacgacaatcaggatgatattgttgttgacgctaaagatgccttccaagataccggaattcccaaggctgctgatgatttggattcacaatctgaccaggatgacggcgataatgagattccaatcactgacgactccgataacaacgataacaaataaaaaacaacctcagtgtgcaatttatccaaacagtcaaagtcaaacttcagctgttgagataaggcacaatgaggttgtttttttgatgctgttaattattgttcaatgtagcgtaattccttggttgtgtgcgtaaatggttcgcagccatcttcggtaatgtgaacacaatcttcaattctgacaccagcaacgtttggaatgtaaatgccaggctcaattgagaagcacatccccggttgaagttccatcttgttgccagccatgatagatgggaattcgtgctcactcatgcccatcccatgacccaaccgatgaatgaagtattccccgtagccggctttggtgatgacatcgcgagcaatcttatccagttcctcagcggttattcccggtttagcagcttcttgggcagccagctgtgcttccagacaaacttgatagatgtccattgatttttcatccggtttaccgactgcgatagttctcgaagcatcactaatgtagccgtcccagacagttccgagatcaaataagaccagctggttattctggactttattttcactggttgccccatggggttctgcggcgtgggggccggcttgaacaagggaagggaaactgagttccatgatcccgtttttcatcagtgcatattggagatcggcggcgatttggtcttctgttttaccaacctggacggcttcaaatccggtttgtaatgcaaaatcgtcccacttgccggcaattttcaatttttcaatttcgtcagccgatttaattaaccgcatttgttcgatcaatggggtcaggttcgctgagaaatccgcgttgggaagaacttgttggagagcttccaatcgttctacctggagctgggatttttcaattgcaaaatgactgtcgtcggtatttctggcatgaatttgatcggcaatcatcacccaagggtcttcgtggtcgaggtagccatagactggggatgaaaagccggtatctttaatggcttctgattccagtgccgggccaaagataaatggttcctgatctttaaaaatggccatcagtaagactctttcaaccggatcactataaaatccggtgaggtattggatcgttttagggtcggtaatcagtgcgatgtcttggccgttatcagccagccaccgttgaatttgttctatcttgttcataggatcactccttcattattttatccacagtatatcatacaaaattcttctcaattatcgccgtaaagttccgttttcacttgaattttcagcaatcttagtttatgatttaactgaaaacgttttcaatttgctgaaaacctttttatttggtatattagatgatgttttgaaaatcgatgaaaacatattctaacgagaaagaaagggctatctttatggataaacaaacaattacaatttatgacgttgccagagaagcaagcgtgtcgatggcaaccgtttctcgagtagttaatggaaatgccaatgtaaagccggcaacccggaaaaaagtgctcgacgtaatcgaaaaattggattacaggcccaacgccgttgccagaggtttagcaagtaagaaaaccacgactgtcggcgtcattgtcccagatgtaaccaatatgtattttgcctcattggcgcgtgggattgacgatgttgcgaccatgtataaatacaatattatcctgaccaattcagactccaataacgaaaaagaagttaaggtgttaaataccttgctctccaaacaagttgacggcattattttcatgggtaacgaaattaacgataagctccgtgaagaattcaagcgaactaaaacgccaatcgtgtttgccggatcagtagatgaagaagatctctacgcgagagtcaacatcgactacgttgccgctgtccaagaagaggttaagaacctgattgatcgtggtaatcggcgagttgccttcgtttgtggccccttggagcaggcgattaacggcaaattccgtctgaaaggctacaaacaggccttaaagagcgctggaatcccttacgacgagaagctggtctttgaaactgatgatacatacaagaccggaaccttgcttcagccagcattaatggcagttaacgccaccgctgcgatggttaccgatgacgagttggcggccggtatcatgaacggtatgtcagatgccgatgtcaaagttcctgatgactttgaaattatcaccagtaacgataccaagttaaccgaaatggttcgaccaaagatgtcttcaattacacagccattgtatgacattggtgccgttgccatgcgtctgttgactaaattgatgcacaacgaaccggttgacgaaaaaaatgtgttgctcccatacggtttgatgaagcgtgaatctaccaaataatcaggtatcaaatcaaaggagtggaccgtggcgattcgctctttttgttctggaaactggtttgaaaagccgccacatatttggccgcgctttcttgaaagaggggggcgtatctggtagaatattgacgtatgtttgtaaccagctaataaattttagaaaagaggagttattatgtcaggacattcaaaatggcataacattcaggggcgtaaaaacgctcaggatgctaaacgtggaaaaattttccaaaaaatatcacgtgacttgtatcaagccgctaaaaaaggtgatcctgatccagaaaacaatcctcagttgcgtctagtgatggaaaaagcacgggctgccaatatgccaaaggataacgttcaacgtgcgatcgataaggcttccggtattggtggagctaagttcgaagaaattacttacgagggttatggtcctggtggtacagccatcatggtttctgctttgactgataacaagaaccgaactgctgccgcaattcgttctgcattcactcatcatggcggaacccttggaacaagtggatcagtttcatacatgtttgatcgaaagggttatattgtgattctgcgcgatggtcttgacaccgacgaagacacaatgttgatggacgcgcttgatgccggtgccgatgatatgaagaccagtgatgatgaattcgaaatcttcactgatcccaaatcaatggacgacgtccgcgacgctttgcaggaaaaaggctacgacttggatactgccgaagttcgtcttttccctgaaaacacgacagaagttccagaggacaagatttctcaatacactggtttaattgacgaactcgaagaaaacgacgacgtccaagacgtttacgaagccgctactttaccagaagaataatttaatatgatttcagtgtctcaatggccgatcatttgatcggtcatttttttatgctttgataaataaaattcaacttttcattcgtatgtattacatgtgaggtgaatgaaatggaaattagtcagcaagttaatggtcttttgaatgaagccattaaaacacaagccagtgatctttattttttacctgaaggagacgaatacctggtaaaaattcgtaatgcaaacgaagtcgttgtttgggataaaatcggctatctgcaggcgagacggatgatgaactattgcaagtacatcgcagatatggcattaagtgaacaacggcggccacaaattgggtcgatggattggcattttggtgataaccaatattttttacgattatcctcggtcggtaatttcacggggttggagtcactggtcatccggattatctatcagcttgatgatgtgcacgcggcattttttgaagaaaaacaagttcaactaatttccgaaatgagtcgaaaacgcggactcattgtcttttccgggccaaccggctctgggaaaacaaccaccatttataatttggtaaatcagatggtttccgaccaatttgtgatgacgatcgaagacccgattgaaattagggaaccgctttttttacagctccaggttaatcacgatgcagggatggactacaccgacttgattaaggtgggcctgcgtcatcggcctgacgtctttatcgtcggcgaaatccgtgatgcaatgacagcagaggcagcaatcaaagccgctctgagtggccatttggtctacaccaccgttcacgctcaggatccggttggggtcattgatcggctcaaacagctcggaatcagcgacgaatttattgcccaagccttaaccggcgtcgcttatcagcggctgattccaaccaccgacggcaaacagcgggcaatgttgatgggacatgattattcagagttggtcaatatgaatacatacgattggggtgaatggcaggatggactcaaaacagctgttaaagcaaaactggttacaccggaaactgcacaacgattcgagttcggttaagaaatggcggtggttttccaagctaatttttttgactctttggcgaatcttttgtcaattggattctcactgactcaagcgttgaaatttatcgccgacactgacaaacaattgtcccgaggcgttaatgtggtgattggatcgttaaagtccggccgggaattttcggaaagtgtccgacccctgattgaaactcaagcttatcaccagctgttaatcgcggagaagcacggtcaactcagtgacattttaaacgaactggccaactttgatcgattgcggctcaaacaactcaaaaagatcaaagcgatgttggtgtacccattatttttgtgcctgatcttaggaacgttgatcttgatgattcgagtctacgttttgccacagattcaggatttaatgcccacagccaatcatcagcaaccggttacgtactggcagcagctgattcgactttcgccaatcccaattttgatcggcatcattggcagcacagttcactggagtcggcaggatgccataacccaggcccaaatgattgtcaaaattccgggcgtcggcaaattgtttcgaaaatatattgcttattatctggccagcaatttggccactctgctgaaaaacggtttgagtgttaaggaaatttatgccacgttatccgagttcaaggagggatcactgattcatctcttaggtgaaaggcttcatgccactttactttcgggagggtccttaagaaaattggtagaccggcacaattttattcccaatgagattatcaaatttatgagctccggcaacacgattccggaaatggccaattccatgacggcctattcacggttgatgtttgacgaaatgatcctgaccaccgataaactgattgggtttattcagccggctatgtttgtggtgatcggtgtgacgattatttcgacgtattttcaactgctaattccaatttataactcagtgaaaggaatgtattgaaatgaaaaagcgcgttaagaaaatgagagaaggctttacgctaatagaaatgaccatcgttttgtttattatttcattattgattttaatcattattccaaatctatccaatcaaagaaaacatgcccagtctgttcattcatcggcaatgaccgaagttgttcaggcacaaattgacgcctatttcagccagcacccaaccgccaaatcagttagttttccagacctgacaaaaggtggctatctaaccgccaagcaggttaaacaagccaaggatgaaggcctgaagattactcataatgaagtgcaaaaataggggtggctttaccgttattgagctggtggtttatttaggcgtggtgttaggtgtcttgatgattaatttgatgctgatcaaggtcgtccaatctggaaatccaagtgaggcgttgttttggcggtcatttcagagtgcttggacccgcatgacattaaacgcaaaggccgagaacatttcttatcgaatctccattcgcgataaagatgttattttctttccgatgaaggtaaagaaaactcactatgacgaggtaaatgaggagcggatttcggttccgccttccattcacgtgagatcacaacgaagcatgattgcccatgacgatgggtttgcatcaccaactaagcttatttggcttgattcggatggtaacgtcaaatacaatcaaaaaattcaaatgggatggagtggctatcatgtggaaaggtacaaataagcgggcttttacggtgatcgattcattaatcgggctgaccatcatctgcaccttcagtttgttctacatccaaaccacccatcaaatgaatgagacaattaccaacgcagaaaaagtgatgacaattgagaggcaaaaatatgaaacagaaattgtccgtgagtaaggttgatactcggccgggctacttattaattgagggcctgatcaccttggtgattggtgtattcgccatttggacgatcatgacgatgatcgtatatgccgggaacgaaaaaaagcaaaacgtgatcaattttcattcttatctcagtataatcgaatctgaccgttatcggtttgaaatcaagcagtgtcaaccctctaagtgcgtgatgtacagtccggtcacgaaaaaaacttatcgaattgaacggtatcaaaacatggttcgattggccggtgcttacaagggtcacgtaccgtcgttgacaaatgttcaatgggtacgctggacaaagagcggggggtgtctaagaactgatgttactttcgataatggccaaaagtgttcagcttattcaaaattaccgttcaaggattgataaatataagcgtggatccctaacggtggtggccgtcatttttgtcggtattttgatgtcatgcttgatgtttcaactggctgcttataagcaggagttgggatcaattaatcgtatcaccgagcatgaacggcaaatgagacggcaatttcttgaaaagccaatcaaaaaagatgttcacccaaaacgcacaagtggtcacgaatagtggcctttttgtggttgtgaaataacaatctaacttgaattattgacagcttatctggtagtatttaatagtgttcaactattgaataaaggggttgagagttctggctcaagggaaaattgagcagctttttgatatcttgaatcgttcgacagaattgattcaaaaagccaaggatcaatcgtatcttgattctttcatcgaaacactgggatttatccagagtgacgatgaagaagatgacgaactgactgaagttgataccaaaaagctgactaatatttatgcagactttaatccggatgacttcactgccgaaactttccggaaagcaattcaaatggctgtgctcaaggcgattcgagttgacacaattcaggctaattaccaactgacgcctgataccattgccaacgttattggctatattattgccggaattttccatgaccgcaaagaattaagcattcttgatccggcaatgggaactgccaatctactaacagcaatttatcatcagcttcaaaccagcattggcgttacaccaaccatttccggaattgaaaatgacgatgcaatgtttgaattggctgcagactcagtcgagctgcaaaagattcacgctgagcttttccacgaggatacgatccaaaatgttttagctcccgtggtcgatgcagtcgttagtgatttgccgattggctactatccaatcgatgctaatgccaagggatttgctacccattcagagacgggtcattcatacgtgcaccatttgctgattgaatttggcatgaagcatgttttgccgggtgggtttggtttcttcctggtgccaagtcagcttttccaaaccagcgaagccaagcagcttcttaaatggatgcaagggaaggtttacctgcagggattacttaatttaccaaaagaactctttgcaaacgctgcggcccaaaaggcaattttgattcttcaaaatgctggcgacggtgccaaacaggtggatccggtaatgttgggggaatttccatcatttaaggaccaacaagcctttaccaagttcttgaccgagattgatgattgggaacaaactgatttattataaaattgtttatcaagctttttaaaaaatacagaggagcattatttattatgggaaaatcaattgcaattaacgctggtagttcaaccttaaagtacaagttgttccaaatgcctgaggaaaccgttctttcaagcggtgctattgaccgaattggattgggcgcatcagatatctcaatcaagtacggtgacggtaagaagttcaaagatacccaagatattgataatcatgaacaggccattcaactggtccttgataagctgttaagtttggacatcatcaaagactatagtgaaattaccggtgttggccatcgaattgttgctggtggggaactcttcccggattcagttgtgattgacgatgaggtcatcaaaaaaatcgagtcactaacggagttcgcaccactgcatgagccggctgcattgcttggcatcaaagcgtttaagaagattctcccaaatatcattagtgttgccgtctttgatacttcattccatacaacactcccagaagtcaactacatgtatagcttgccttacgagtattatcagaagtatcaagttcgtaagtatggtgcccacggaaccagctatcgttatgtctctgccagagcagctgcccttttaggtaagcctctgaaagacctgaaattaatcgtccttcacttaggtgccggagcttcaatcgacgcaatcaaagacggcaagtcatttgatacctcaatgggcttctcacctgttgccggcattacgatggcaactcgttcgggggacgttgatccttctgcattacaatatgtgatgcaaaaagccggtattaaaaacatggatgatatggttgatattttgaaccacaaatcaggtttggtcggtttatcaggtgtttccgcagatatgcgtgaaattgaaggggttatgaagactaatcaccgggcaatgctcgctcgcgaaatctttaagaatcgtatcatccgctacattggcagttacattgctgaaatgggtgggattgatgccttggtcttcactgccggaattggtgaaaacgacattatgattcgccaggaagttaccgataagttgggctacttcggtatcaaagttgatcctgaaaagaataacatccgtggcgaagaacgtgacctgtcagctgctggttcaacggttaagacattgttgatcccaaccgatgaagagttaatgattgttcgcgatatcgaaagattacgcaaaacacagaaataatttttggacgttcgtcattaatacccaatcattacgggcgaagatcgttgctttttcaagcatagaatccgttgagccccatttgaattcggacgtcgcgggttacaaacgaggctgagacaaaagggttttgccttttgtcccagccttattgtttaataaaccaaattgtcattttttagaaacggaggcacattgtggaaaatcaagaagacgacaaccaactgtcccggggcctcaagaatcgacatgttcaattgattgcccttggtggaacaattggaaccgggctgtttcttggtgccggccagtccattcatttagcaggaccatcaatcatcctggcatatgggattgccgggctggcttgtttcctattaatgcgggcgctgggggaactgttggtatctgatgtcgaaagcaattcgtttgttttcttcatcaaaaaatatttaggcgaaaaaatgggcttcgtgatcggctggacctattggatgtgttggatcgccattgcgatggcagaagtgacagcctctggattatacgtccagttttggttcccggacattccaatctggctgacaggtctggtcctcttattgatcctatttatcatcaatatcgtcgctgtatcagcattcggtgaaaccgagttttggctggcaattgtaaaaatcgtcgcaattgttgcactgattgtcattggaatcgtcctggtggcaatccattttaaaacaccatacggacacgcatcattgatgaatgtggtggatggcggtttctttgccaacggtgcgaagggttttgttttgtcctttcaaatggtgctcttcagtttcgccggaatcgaaatgattgggatgacggcttctgaaacccaggatcctttggtgacaattccaaagagtatcaacgaagtgccaacccgggttctcttgttttacattgggtcgctgttggcactcatgagcattttcccatggcagcacgtttcgccaacttccagtccttttgtccaggtttttgccggtgtgggcatccagtccgcagctttgattattaattttgtcgtcttaactgcggcaatttcagcttgtaacagttcgttatttaccactggtcgaatgctgttttcattgacctacaacggtaaatcaaaattcagtcgaaaagtcggccgtctttctgcccgtcaaattccgtttaacgcaattcttttttcgaccttggtgatcgcggttatcgtgctcttgagtattatgatgcccggcgacgtcttctctttcatttccagtgttgctacaacttgtttcctgtttgtctggggaatgattgtgttggctcatatcaagtatcgaaagcaggttaaaaaaactggcagtcagaaatcgctcaaatttaagatgccgctttttccaatcagcgattactttgtactgattttcatggcttttgtggcagttgttttgaccatgaagacggatacgctgattgctttaatcggctcggtggtttggctaattggactgtttattttcaaaagtctgacagataaggttaaagaagttgaaaaatgataccatttaaatctaaattattatgaaaccgtcagccagcacattttattcagttgtttgtgctgaatgatccgccaccaactgcttaacagccttcatcgctgcagccaaggcctcatcactggctgcgtagctgatccgaacgtattcgttatcgccaaatggatctcctggcatcaagccaatgtggtattcctttgccagtgtattaacaaagtcccaactgttcatctgcagatctgctggaatcttggcaaaaacatagaacgccccgccaggatgaacgacgccaaaaccggcttcagccatttccttggcgacaaaatctcgacgtttttggtattccttcagcattggtttggaatcgtcctgaccgtgtgtcaacgcctcaatcgctgcgtattgaacgattgacgcagctgcggtcacggtgtactggtgaactttggcaatttcatcgatgaaaccgctgggaccaaataccaatcccaatcgataaccggtcatggcatgagacttggataacccgttaatcacgaccgtttgatccggcagaacttttgagatggaatagtgcttctggccgtatgtcagctcgccatagatttcatcactgataacccagatgccatttttctttaaaacaggcgccaacgcgttaatttgttcttcggtataagcaacgccagtcggattattcgggtcggttaaaatcagacccttgacatcccagtcagggtggtcggcaattgcctgattgactttggccggggtcaaaataaagccatcatcgctggtgtccaccagaatcgtattcaactcgtttaaggtcgtcaaagcgttatacagcggataggccggcgtaggaataatcacggcgtcaccaggcttaaacaaggtcttcactgcagaagcaacggcctcagtcgccccaaccgtcaccaaaatttgatcagcggaatagtgatagccgaacttagcttgataataagttgatgcagcttcacgaagcggttggtaaccccaatagtaaggataatgagattcgttgtggttaatcgcgtcgattgcggcctgcttaatatggtcgggaacgttgaagttgggctcgcccaaagttaatttgataatctttggatcggaactaatgtcatgatcaaatttccgcattgcggacggcatgacttttaacacataagggttgatactgtctaattccataatggtgacctccggaaaactcagatttaaaacctgccaatgattcggtaaaagttattgttaataatataacaattctctgagaagtcaatgaaagatcaatcgattgtataattatgcctttgattcttgattgccgtgtatttcaataatcgtatggtaaaatcgcgtttattcttacacggccgtgttagttccaccattatcatttttcagggaaagccgcgactttcaacacattttcacgataggttgcccagtacacatcgcggatattgtcgaagccttgcttggcgagctcgtcttcaagccactgctggtctcgacccatgagatctaagacgtccggatccacctggccgtccacgattaccgggtagcgaatactaccctcccctttattcaaaaccgtcagctgaccgttttgttccaaaatggcccgcttcacgtcttgaatgtcatacactccggcagttcgcagcttgaaatcaacatctttaccggagagattggcgcgaatgcaattctcaaccaagagctgaccattacgcaccagtgtgattggctcaccctcgataaatttgccaaaccagtgaatatgggttttcaaatatctggtcaccatgattaacagtgcccaaagcaatagaatcactaaaaattgcgccatcgtgatggccggattataaatcacaccgccgataatgccaccaaggacgtagttttgcagctgatccattgctgatgtcggtgccagattcccttttccggtcaggttaatcaaaatggtgataaataagaaaccgacgattaatttaagtgcaacgtctgaatatgtaaacatatcaatttgcctcctgaactttgatgtggctcgaactatctaattcgaccttttccaacacaaactgactcccgtcagcgttatagtcgacccggtaataaccgctgggggtcttagccatcaggttggcattttgggtggtcgaattgatactgacgcttttggttcccacatgaagccgcttggcaatctgcttaactgtctgcgtaatctgaccagtctgcgcagaagcggactgaattgcactaaagtcgtcgtattggatcgctaaaataagcagcagcgtcccgacgataatggttaaatctttgtatttgctgtccattcgattacgaaggtaatggaccaaaaagccaataaaaatgactgccagcacgcttaaaataatgattctggcgtactgccagctactttgagaaccttgaagatagtcgtacgtgtaaaacgtcattgtgcatccccctttatcgttatcttcattttatctcaaagtttcgttcaattgttaatccatttggtgatgctcggccaactgtaattattcacaataattcttggggtgagttttaagttactatggttggtcaccaagccatcgttcaaggtcaagatgacttttaggccggggcggttggcaagaaacttttgaatctgggagtcgccgctgccgtatggataagtaaaaattggtgacttatagccgaccttttccttcaagacatcctggctgaccgcataatcacgcttaaagcgagtgtagttcgccggaatgttgaacaccgggatcccgtgatcaaccaaataatgcatccgattggtgtgaacaccaaaggtcactaaactatcggcctgtttttgcagcctttggattgccggccaagttgccaatttagttccctgcttataccaaccggtgttgccggtaataatcgactgggtaaacgggtaatgtaatttttcgaggatcggaaacgcattgtcgatcgacgtccggtcaacatcatcaaaggtaattaccacgtacttaccgcgaatggggcgcttgctgtgagccatagcaatcatttgtttgattgaaatcactttgatgtgatgggatttcaaataatacatctgctttttaaaggaaggcaggttgacgttaaaatcgtgaaactgtgtgttcggcgacactttttcatcgaaccggacaatgtcattcggtgccaaaatccggtggtaggagaacaccatgatgccatttttgattcgctggtcacgtttggaaatcgcaaaatcaggccgattgcccagctgataggcaatattgtgtcgaacactgactgccaaaagtgccaaaaagaccagaataaaaccgcttagaatccacttacgacttgttttgctcatgatttttcgccctccgctcaagtttcttaattcgcagccaaccaaaaattgtcatcaagatgaccatcaccacgaccaggatggcaaatcgggcataggcaaagtaggacaggttcaaaaagaggtaatcagaaaccagcgtgtccgagtatgcgttcaataggaagcaaacgttgacgtagatcacgtaagctgtcatggcccacaaagccaccaaaaagatgaaccgttccaacaatttaagaattgaggatcgtttccgaataatcaggttgttagtcttctttttcatgattaaagcccccgatccggactacgccaactgccaacatgactcggatccaggaagaacgatcccagggcagttaggcaactgaccaagttgatgaaccaataaaaaatcacatacagtggcaacagtgacaggtcctgccatttgataaaatcggactctctggaatcggcataaccaatcaagaattgaatcaaactaatgagcaatagtagaaataaaatcacgccgtccatgatgatgtcacctgtgaacataatcgtgaacagataaaacaacgtcacaaatgagcagctgatagcccacaaatcactgagcaccatgtccatcagcagccactgttcactcaagcgaccggtgataaacatcccccggttgcgaaacagcacttcaaagcctccgcgggcccagcgccttcgttggtgaatcaaatcgattattcgttccggaaccaagatccatgcgaccgactccgggcagtaacggacctgccagccatggtgataaaggcgccaagtaatatcaatatcctcagtaatggcatcgatattccaccagccggcatcaataatcgcctattttcgataagccaccaccacaccggaaaccgttgtgatgtggccaataacgaaagcctggccgcgtttgataatatcgattacgcccacatattccaacaactgcagccgacctagaatactggtccggttgcggacaattggtttgccggcgactgcgccgactttcggatcatcgtaaaatctggccagcatcggttccagaacattttgatcgacgtagcaatccgcatccaggcacaacaaaaattccccttgagccaccttggccccttcattgagggcgttggctttccccttattgaccttgatatcaacaattttaactggaaactgatggccataccgttcctgaagctgagtcatcaccgccaaggtattgtcttgactgccgtcgttcattaaaatcagctcaatccgttggtaagtgatctttgagatcgactcgaccacttgggccagggtgtcctgttcattgtgggctggaatcaaaattgaaaccaggtcagctggttgtccttgatggtcgttattcagcggtacccgccgttcttgaatggagaaaaagattgaccccacgatccaaattgtcgacacaattactggatataaaatgacaaaatcactcaaggtactcataatatccccccattctatctactttcggccaaggccaaaaaggttttgatgaactgctcactggcggcgtacacctgctgatcattgaccgatccagccgagtctgcccatagtgatacgctgctgccgacaatcccccgtttggacttcaacttggtgtcaacgtcgttgtgccataacgtcggtttccagtattgcttcatatccttaatcatataagcgacgtttttcttggacatgttggttttggataaattgaaatacagatagtagtcgttatagttgaaaactttggaaccacggttgatcaattttggcatcgaggcccagtatttgtggcgctcagcagctaacttgccggtttgatctgcggtccagttccagtaagttacttggatgtttttattgagtttgctcaaactgctgtttaaaaagccgtcgttccaagcttccggtgtgaaccccattttttccacattggcgctggtggcgtttaaatatttgacgtaagcagcgttgctggttagcttatcggaaaattcatcgccgcctaaatgaaagcggggattggcctgcccggcaaacaaggtgccaacctcgtcgtccagctttttggtgaaatcaatgccggtttgattgaggtgaatctcgtcgcggtaactcttagagtaccagctgacttgatcagccagttgtgccttgccattggccttcatgagcttcaccaaggcagtcacatgcgctggggtgtcgatttccgggatcagcgtcacgtggtgctgttcggcatcgttgaccaaatacttgatttcggccttgctgtaaaagaactggtgggtctttttgttatgccaaacgccatcaaccttctgggcattcttcaaggactgaccaacgtagtcattttcaatcgcaaaattccggtcatcgcttaagtgcagctgaataaaccgaccattatgatcccccactaattgaatgaacttttgcaacgttccgacttggtagtggcgccgggcaacgtctaaggtcactccgttatatttgccatcctgttcactcgccgtgctcgaagtcgtctgagcggtggtcgtcttgtgcgcgctgcatcccatcaacaataccgtcagtggcaatagcagccaactcttatgtaccatatgcaatccccccgtcatgcaatcttgaaatatatctgtaacatttaatcagatacatagtaccaaacatcacagattttgctattcccaggctttcattctgaacaaacgttagacactcttaacaaataatgagattgttattaaaatgacacctttttggaaacatgaatctatgcacaaaaaaatggaaccagctgttagccgattccatctttgaaacgttcaattttaatttagacactccggcgcttgaagacaacgtagctgattgccatgaaaattgctgtgtataccagactgccgaccaccatttccggtgtcgataacaaagtcattttatgaaccgaactggatagcaactgttgtggcaggttcatcatgttcaatgggttccacttcagccattcccacttgtgcatcaataagaacatgaccccggaaaccatgctcaaagcaaagtaaccgataatcccgattgaaatcgctgctgcggtactcttgaagatattggccaataataataccagactgagaaccagccagatcgttagaaaggagccgataatgccgagccattgtgcttcgataaccgaatgacctgattgataggtatctgaaagtttgaatttatcgttaaacaaaacaactttcaaaagcatcgaccagacaaagctcaaaacatagaaataaatcgagtacagcaacatggtgatccacttgctgaccaggatttgaccccgatagtacttgcgatacaataattctttaatcgtgccgtactggaattccatcgcaatgattgagctgcaggccgcaatcatgaacaagacgatccagttgatcccggtaaacatttcgacaaataatcctttgggatcaccccagtacttgggatagtttctggtcaatacaccaaaaacagtcatcagaatcaataatgtagctgagactgcgtaggtgcttttcttatgaagcagtttaaagatttcttgtttgactaacgttatcatgctatgactcctttactttgtcgtttttgagcagatttaagagtgatgtttccaaatcgctgtgaacgtgttggacatcttcaatttcgatatcgttatcggacagtaatttgatcacgtcagccatcttggttgagtcagtttcgacaatgctgagcttatcaccgtcatcaagctggtagccgttttggctcaaaatatctttagcatgggcgtcgtctgaggtcttaagaaccaataacttcttaccgccattttccaggttggccatgctctcagtgtaaacgatctgtcccttatcaatgacaaccaggtcatcgaccaatttttccaactcacttaagatatgactggagatcaggaatgtggtgccttgtttggccaaatccaaaataatggtccgcaagtctttgttggcttggggatccagaccattcatcggctcatccaaaataaccagtttggggcggtcgactaaagccaaggcaatcccaagcttttgtttcatacctaaagagtaggtcttggccttgcggtttatgtatgaatccatcttcatcttgtcaacgatgtccataatctgatcttttgaagtcgattcctttgaaaataactgcaggtgctgataacctgtcaggaatgggtaaatcccggggtattcaattaaggcgccaaccttatccatcgcccgatgactggtgggtgaaactggatcgccatcaatggtgatcttgccgcttgagtaattaaagagtcctaagacggctttcataatggttgatttaccggcaccgttgggaccaaccaagcccacaatatgtccggtttgtactgaaaacgacacatctttgagaacctgcttgtggccaaagttcttgttaagatgctcgacatttaatattgagtctgccatgtgttcctcctagtatttatactcaaacacaattctacaagtaaagggccactcattttcatgaatggttggccttaaggataacatatgtgttaaaacttatacaacaccccatttctcatcatcctcatgaattatctgttatgatgggggtgaggaaatgaaatcgacaagtctaatcagaacgaaaaatcgaggtaacgctgcttatgacgaaagctttaatggttgtgacaaacaaccccaaattcaagaagattcaacgggccaccggaatctggctgaaggaagcgacccatttcaacaaagtgatggccgataacggcatcgatgtcgattatgtcagtcctaagggcggttatgtcccgctcgatcctctgagcttgggaaccgatgacatggacgccacggattgggaatattatctggacgacaccttccgaaatcaccatttggcccagtcactcaccccggccgacgtcaatccgaaggactaccaggtaatttattttgttggcggccacggaacgatgaccgatttcccacagaacaccgaattggcggggctggccgaaacaatttatgccaacggcggaattgtctcagccaattgcgtcggcgtgtgtggcctgctgcccatgcggacagaagatggcaaacgctttgtgcatgggcgcaagctgactgccttcaccaatgatgaagaagccttaaacggtctcacgaatgacgttgagttcctgctggaagatgaattggacaaagccggtgccaacttcgtgaaggggactgcctttgagccgaatgtcgttgtcgacgaccgactgattaccggccaaaatcccaactcagcgactggtgttggtgaagcgattattaaagagctgctgcaataagggttcgtagagagttttgttgccctatcatatagaagtaactatcaaaatcaaaaacgtctgacacaaatagaaaaatttgtgtcagacgcttttaatttttataggatgctatcccagaatttgtccggaatcgatcatcagattatttattaatgttttcttcttcaatatcttccaaactgcggcccttggtttccggtacccgtgaatggatgaaccaaacacccagcagacagatgacaccaaaaatagcgaatacggcgtcttgtggcatgctggcggtcatgatcgggaagagcaggccaacagcgaatgaaccaacccagttggcagatgaagcggctcctgatgcccggccacgaattgccagtgggaagacctcaccaatcagaacccaagttaagggtgcccaagtaaatgagtatgcggcaacgtaaatactcaggaagaagacaatcagtaatggactggcgtttggtaccaggaacttaatggcagttggcaggaggaatgataatcccatgaccgttccaccaagaattagtaaggtccgacgcttaaatttgtcagcgattcccaagaataccagtgatccgattaccaggataattccttgaataattggccacatcaaagctgagttagctgcagttcctgtcgccttttcaacaatcaatggaatgtaatagaagattgcattggctccttggaactgttggaaagccgcgacgccgataccggcaattgccaggtaacggtattttgaactgaagacagttgcccaactggttgattttgaaattttcttttcttgtgaagcagtatcttgaatttgctctaattcgtcatcaatttcggtgtcgttttcccggatgtagctcaacactctgcgagcatcgtcagggcgaccgtttttaactaagaaacgtggtgattcaggcagcttcaatacgccaaagaacaagatcaaggcaggcaaggcagccaggccaagcattgaacgccatgcccagttctcaggcaggtctttcaatacgaaatccatcacgtaagatagcaacatcccagacacaatcatcgtctggttaatcccggtcaaacgcccccgcattttggccggcgccatttctgacatataggccggcaccagagctgaagatgccccaacggcaaggcctaagaagacgcgaacagcaatcaggtagaattgcccgtcatgcggtgagatggcagatagcaatgatccggccatgaaaatcagagctgaaagcaggatcatctttcttcgacccatcttatcggacagctgcccggcaatcgcaccaccaaagatggcacccaacattacagctgacgtaatccagccagtgatcgtcgcattattttgcagtccccaatcagtttgtaaaaatgggagtgcccccgtcataaccccaatatcatatccaaacagaatcccaccgaatgaaccaaagaaataaataaatccgcttgagattttcttttctgttgcaacagccttttccatcatcattctcctttacactttaagccaacgcttgattagtcgtgattccccaatccaaaagattggaaggggttacataacaaatcagacaaatccaacacattctttgttgtgtgacattctctcttatacgcacagtcgtaacgcttacattcatttacagcattacatatggaccgctatcaaaaaataaccagcgtccatagtttgttatgttaacggattcatccgtataaatcaagtactaaaactggttatcatacaaatttctaaattggaccaaacaaaaatgcactcaccccagtgtttacggcgaatgcaaaagttttactaatattagtattacgtttactaaaaggttataaagcgttaaattatgataacgataatcggaataattgtaattaatggtttcattattcagacttttgaatgctgccggcgatgtcgtcctttgaaaaatcgtgctgcataaagtccttatcactgaccggcaaatgttgttcaaaggtatcaaacagctggtagctgacatcaccctttacaaggtggaaattcaagacgtggccaccaaacttgcggtcatcggaaatgaagtggtgatgaaagccgcccacagctgcaccctcgaacagttgtggggcataatagccaatcaacgtcccattaatctgatcccgggtgaagacactctgattttcagcggtttcagccaaagtattatacggcggctgagatttaaccgccgctctggtttggatgttggcaaaagtgccggttattttaatggagaaaaaagtgttggcagctcgacttaacgagaccaattgtttgttcaaatcagcctgatcaacgttttccagttcggccagtggcgtgtagcgggcaaaatgggcattggcaaacggcatggtgaataacttgggggctagtgtgacatccccggtggcgtggacgtgatatggtttgccatctagaataatcaattcaccatccaatccttcgccagtcccaatgccggtatcgccatgttttaacagttcccccattgtaatggttccctttaaaagcccgggaacaagtaatgccagcgttccgtgctgatatagcgtgatatgatttgccatgttaagactcccctgtgtgtaatgtaaaagacctttcctttaatggtagcacttcgcaggaagggtaagccaacaattctgacaagtttgtgaatatcagcaaaattcccaccggattgtgatagaatttaacaaaaatgacgtgaggtctcctttcatgaaatattcgacattactctttgacgttgatgacacgctgttgaatttccaggcagctgagcatgacgccctcaaaaaattattcaaaaccatcggccagccgctgacctctgaggtctatgccgactaccatcaatttaatgaacagctttggcagcaatatgaattaggcgaaatcagtcgacaaacgctgctggatactcgattccgtcgtttcttcgaccattacggccaagttgttgacggaaaagcctatgaacaacggtatcgcagttttctagccgaaggtcacagcccgatgccgcaagccaagcaattgctggccgacctcagtgcaagtcacgatatttatgtcgtgaccaatgggatcgccaaaactcaacatcggcggctcaacgagtctggtctggcaccctactttactcatgttttcgcgtccgaaactatcggcgtccaaaaacctgatcctggcttttttgactatgttgcacacaacattcagggcttttcaaaagaccagtcactggtgattggtgattcgctgacctccgatattaaaggggccaatttatatggcctcgattcagtctggttcaacccaacccatcagcccaataccatccgattgaagccaacttatgagattgatcatctcctgcggctggaagcaattgtctaattgaatcaagctcaaatgactgccccatggagttgaacccacaattggttcacaggtgacagtcatttttgttttggtaaaatgttatataacctaacacgatatcttgcatcccattaattattaacctatactaggtgattaattagaatatctctaattaatttctaattcggttctgaattaaaggaggtcccaacatgcaacgatacagccaaaaacgggttacaagcaatatcattaaaggttctttaggcaatatgattgaatggttcgattggtatatatatgcatcctttgccatttattttgccggatcattttttccagacggtgatcaaaccgtcgaactgctgagtgcagccgctatttttgcggtcggtttcctgatgcgaccgttcggcagctttatcatgggtaaatatgccgataaaaaaggccgccgggccgccttaacgctctccgtcagcatcatggcaaccggatcgctgttgattgccattatcccaacctacagttcaatcggcgtttttgcgccgttgctgttggtctgtattcgtttggtccaaggattatcacttggcggcgagtacggcatttctgccacttatttatcagaaatggcaacctctggacggcgtggttattacgcatcgtttcagtatgtaactttaatcagcggtcaactgatcgccttaatcgttcaaatcattctacaatcaatgctttcggatggacaactgcgggcatttggctggcggattcctttcgccattggggcagttggcgccgttatcgttttatacctgcgactttcaatggacgaaacaaatcaatttaaacagactgagaaaacaaaggccaccagaggatccttgcgtgagttggcaaaatatcccaatcaagtgttgaccgtcgttggattaacctttggtgggacaattgctttctacacctacacgacctatatgcaaaaatacatgatcaattcattggggctggcaccaaagctggtcacaatgatcaactttggtgccttgctgatttttatggctgcccaaccattgtttggccacctttcagataaaattggccgaaagcccttactctactggttcgggattggtggaacaattttgaccgttccaatctttctcggactcaaatccttcgatagccccgtggcatcgtttctactcatgctaggcggccttctgatcgtcagtggctacacttcaattaatgccatcgttaaagcagaattatttccgactgaaattcgggcactcggggttggttttccttatgggctgaccgttgcgatctttggtggaagtgttgaatacattgccctgtggctcaaacacatcggtcatgaagactggttcttctattatgtatcagcagcggcatttgtcagcttcctcgtctacgtcaggatgctggagacatccaagcattccaaactggaagaatctccggaaacgacggagcctgaccaaccacaggcaccgactgtcagtggaccaaaagaccactaagcctttcgaaaactaaaaggcaacttccttgcgaccgtctcccagaatcgagtacactgactgtgtaagcgaattcaaaattattctgggaggtaatctgatggcagacaagtacgattttccaaagacacgcgcacaattgaatcaattagtcgcagatctcagccagctgcagaccaacatccaacaaacccactggtacatgcggggtgagaacttctttcgcctgcacccgctgatggatgattatagtgatcaattagctgatcaattggataacgttgccgagcgactgatcgcaatcaacggttcgccgttcgcaaccactcacgaattcattgataacaccggcttaccggacgaaaaggttacctgggatcaattaaccatgcgtgacttcatgcagcggctggttgatcaattcaggtatttgcgtgatcaatatcaaaagggcatcgaggtcactgacgaggaaaaagattttccaactcaagatatgctgaatggctttaaagaagacattgataagaatatttggatgattaacgcctacctcggcaaagggccttacgacgaataatcaattatcgaaaaatagacacttgggttgaaatattttaatttcagccctatttttatggcagagcattattgatatgtaaggaggaattgactttgaataactcagttaaaattggtaagagcgaggttgtcagcggccccttgggtctggggaccaacaaggtcggcggccataatttatttgacggcctgaaagattcggacggcgaggcagttgttaaagcggcattgaacgacggcattacgttactggataccgcatttatgtatggattgggcaagtctgaagacattattggcaacgtcattcaagatttcgatcgttcaaaatttgtcatcgcatcgaaagcagctcaggatcccaacaacgacttgaagcctaataacgatcctaagttcttgaccaaatcgattgatgagtcgttggaacggctgcaaaccgattacatcgacattttttacattcattttccggatgacaagaccccgaaggcagaagcagttgacgcgctggcccaggcaaaaaaggccggtaagattcgggcaatcgggatttctaattttaatttgaaccagatcaaggaagccaatcaagacaatcaagtcgatgtcgtggagaacaattacagcctggttcaccgggatgcagaaacagaaatcttcccgtatctaaaggcacaccaaatttcctttgtcccctatttcccactggcttcaggcttgctaactggcaaatacagtcgaaacgatgcagacaagttcagcaggttctctacatcaaaattcaatcagatcatggatagtttagatcaagtcaaaaccatcgccgaaagtcatcaggcaacgattgctcaaacgattttggcttggtacattgccaatcctgatattagcgtggtgattcccggtgcaagattgccagagcaagttgatagtaatgccaaagcgttggatgtacaactgagtccagcagaatttgatgagattaatcgattattttgagatcgatgaagtttgtttcttgatccaacggatttaacataaaaatagttgaggggccattgggtaaattccaatgacccctcgttttattcacatttcaaaaatataatcgcgtacctgctgagctgcctgcaaaccaaatacgacggtttccgcaatggagttgccaccaattcgattatcaccatgtaggccaccaaccacctctccggccgcatataatcctggaatcggttggccgtccgccttaagcacttgagtttgatcgttagtcttcaaaccgcccattgtataatgaatcgccggggcaatgtgaatcgcataatatggggcagtttcaaggatgtggcggccggtcgttctgccaaagttaatgtccattcgatcggaaacggcctgattccacttggctacggtttgcgatagtgtatcactatcaacaccaatcagtttaccaagtttggctaaatcatcgcctgtcttaaccaagccaacatgatcatagaagtcaattgccttggcacgtttgcgaaccttggcatcaaagatgaggtatgcgccagtaccacccaacttctcgattgcgttggtaactttgtcgcgggtttccatttcattcacaaaccgctttccgttttgatcaactaagatagcgccctcgccacggaccgtttcaccgattaaatagacgtggtccgtatcctgttgaacggtggggtgaatttgaattcgatccatatcaaccagctgggcacccagatgctctgccagcaacatgccatcaccggtatttccaggctggttggttgtcttgtatttggtaagatccgggcgatactttgcaatgagtgacttgttggcaccaaacccgccagcggcaataatcactgctttggcgtgaacagtttgcgaaccgttttctgtttgaatttgaacgccggaaacccgatcatcgtgcaggatttcagtcactttgacgttggtgaacagtggaatctgttttgcctgaacttggcttagcagaccattaatcaagtaaccaccaattggttgagtcgaacttggtcgatgcgcccggggcacactcatgccaccggtaattgtcaaatcatccagctggacaccctgtttataaagccactcgattgcccgcgcaccatgctcggtaaaattcttcaataacgctggatcgttttggccatgaccgccacgcaacgtctcgtaataaaaggccccaacgctatcttcgattccatgctcagtctgaacaaaggttgccgcggcgttcatccccgacgaggcccgtttagtatcaccgccaacactcggcattttttcaaaaatcactggtttcaatccgagttcggttgcccgaatggcactggtgaggccagcactaccagagccgatgacaatgacgtcatactgatcttttagttcatctaatgaatttggttcaaatggttgtgacatgaatttcttccaatcttcaattatttattgagcacggcgaggtgtaagtccatttggcccgtgcatttgaatgcttgccgccaaggcgcgccaggcactcgtgtatagctgtggtcgtttcccctctgccagccgacgcgcctgttgttcacaatacgcggtaatgaatgttggcgaatacttctcatccaacttccgactccccatcgttagtggtagtggaactggttggtagctgccagctaaaatttgattaggcaggtccggcattaccgccattggtgtacacattccgatcatgtcggcgtcgtgggttcccagcgcctcttccatcgtggaaattcgtctaaacccgccactgagcacaatggggacatctgtaagttgatggatcatatgggcatagccggaaaagccaacggttgagttttcgtaatcatcaccagagatttcaatcaagtcgatgccaaggtcggccatcttttggatcacggcaatcgaatcgtgttcggttaatccttccaaatcaaggtcaagcacgctgagctttagcccaatcgaaaactggggcccacatgattcgcgaatcccttcatagatatctacgagaaatcgcattcgattctccagtgagtcgccaaattcatctgtccgctggttgtctttgcgagacaagaactgattaaccaaataaccgtacgcaccgtgaatttggacaccggagaagccggcttcttgggcaatctctgcggttcgaatgtatttagcgataatctcatgaatttcagaattcttcaattcacgtgggggattaaaatatttctgattagggccatgtacaggaatggcactgggcccagctggttgagtggacaaatattttggtgactgtttgccgggatgattgagctgcatccacaactgggtgtggtttgtcgttcccgcttgagcccacttttgaagggttgccaagctccgctcatcctcaacgaccacgttgccgggttctgccaaggcggttgaatcgaccatgacgttaccagttaccacaattccagaaccacccattgcccatgctcgatacaaggtggcatatcgttcatctggctgatgatcttggttagccattgtttcactcatggccgatttaaagaatcgatttttgacctgctgaccgttgggtaacaccaacggcttggcaacttgtaagtaattcatttgcagctcctttccagcaaatttgcttaatcgacgatatgatttgatttaatggtaacccgatttgacccccatcgcaattccagcctacataaaattcaattttcagttacaatgaacccagaggtgatgattcaatggatgatcaatggctatcacaactgcccatcaaagggattactaaagcagtccccgttggtggcggcgatgttaatcaggcatttcgattagaaacaaaagatgacacatatttcctactggttcagccccagacgactgccgacttttacgctggcgagattgctgggctcaaagctttcgaggaagctaacgtcttggctccccgagtgttgggcaatggtcaaattaacggcgatgcttatttgctgctgaactttttggaatcaggttccggcagtcagagtgacttaggtgaactggttgccaacttgcatcagcattacagcaagaatggaaaatttggctttgacctgccctatgtcagcaacgatgaaagcttcgataacagttggaccgactcttggagtgaattattcgtcaaccaccgactggaccggctccgcgatgctttgatgaaaaagcatttatggaatccaagtgacgatgaaaaatacaaacgggttcgcgaagtgattctcgatcagttgtcgaagcatgagagcgagccatccctgcttcacggcgatttgtggggcggcaactacatgttcttggcggacggtcgtccggcattgattgatcccgcttctttctatggtgatcgggaattcgacctggggattaccaccgtctttggtggctttgacgcggacttctacgccgcttataacgcagtctaccctttggatccgggcgccaatgaacggctgaacttttatcggctgtattacttgatggttcacaccaataaattcggcacaatgtataagagtagtgccgacagcgcgatgaatcagattttggaacatgaataaattatagtcgttgagctggacattcttgtctggctctttttacataattgagtaattatcgttacttattcgaatcccgttcgttatatacagtgaaagggggttgtcatgaaacttgatgagtatgaggtactactgaaaaacatctcaatcgaattaaatcatttcctggtttcacgcggagctagtaaagacatcgcagaagacgttgttcaagatgtctttgtaaaagttttggaaatggatctaatactcccgccagataagattcgcccttatatgtacaaaattgccaaaacgaaatacattgatttaaatcgtcgtgaagcccgtcttcagaaaattttacaacaataccttattccgcagcagaagcaaacgagggaaccacacacagaagacaaatcaaaaaaactacagcgaattatccaaaagttatctcctggtgatcaagaaatcttaaaaatgaaatacatcgaaggtcaatctattgatgaaattgccaccaatctaaagataacctctccaggagtgaaaatgcgtttgtatcggttgagaaagaagattaagaagggatttggtgaatcataatgaaccaagataaacaatttgaaaaattagcttttcgtattaaactcaagcgttgggtaatcacaattttattaattattattctttttccaataatgacggcagttggatataaaattactcaatctttttccgcccgtcaatctagtgggcttatgaaagagatggaaattcaacaagacctcatgagccccaatatccaaaacagtgacttggttattggtaacagtaacattggcggcggcactgtcgtaagccaccaatataaagacattgatggctatcatttaccatggcagactgtcgaaggtaagtacaattggttatatcatgaaattcaaaccgataacttagtggatacagataatcaggcggcttacacgagaacaacccaaaccaagattccgttattttacaataatcgagttaaatcaccaaatgtgtcgaaggcttacgaagttaagaaaatttcgcaaatgaaaaattatgtaggtgaggtggctttgacctttcgccatccaatgacatattcacaaatactacaaaagctgccgaaaggcatccaagcaaattggttctggcttggtgtcaacggtaaagcagatccaacgattgaagataattgttttcttggaattcagtcatttaatggcaaacttggtccaaatgactataagggcttcagaaaatcattgcaaagtgctaaaaatctcggcacatataatagtttttcaatcactgactatgcccacggatttgccaagaaatatccgacattaaatcaagcaagattttctggcatcatcattactggaaaaacagaaaactttaagcccttggtaaaccaaaattggatcacagaaagttcggttggggcgacaatcaaacgtgttccgtatattaaacctagtttttaattagcataagtaccctatcaaactaaacacaccccttaaacttcaaaaagagtccaaggggtgtgtttttcatgattaattgccaactattgttttggattcacatcgtaaacctcaacgcaatagccacggtaaccgcaattgggacacgttagtttccgcgtcttggcagtatgcttggaaaatgtaaagtcacgccagctcggtttgaaatgctggtgacaatttgggcagatatactcaactttgttgtaataatcccggataatccaaatggccattacaatcacaactgggaagatgattgcggctggcacccaattgccggtgataatccaaacggcaattgctaagatttccagtgcatccatcatcagtccccaagttaacatccaccagcgaaacttggttaattttggtttgctttccatcatattttcgatgccgtcaaggtcaggttgggaaattagcgcataatcagccaggctgtcttgaaccttgcgaatcatttccagctgatccgcggtcattgtcatctcatgctgaattgtcttttcctgttccttaagcatcaacgacaggacttgagttgaattatcttctgataacaggtctttaatcgtcgtcagagataggcccattgatttcaacaataaaatcaatcgcaaggttttcaactctttgtccgtgtataagcgacggccgccatctgaaatggttgtcggattcaagattcctttttgatcatagtattggatggttctgattgatacaccacccaacttggcaaactctcctgttgtatatgtcgacatcggtttcacctcctgattctgttatagctgatgacgtaaggtgatgagcaagggaaatctgaatgtaattgaattggtttttgttcgcaaaccaattgcaaaccaggtttgcgtcttttttatccacaattatcatgcaccatgggttaattcaagacctttatggccattactttaatgccgtaaagacacccatcacaaccaacagaactcccagaatcggcttcacatatttggtgaacttctgaggatcgagtttgcccaacaggaccggcgccaaaaatgatcccagaatcgccccaaacatgaggccaagccccaccgaccagtcaacgttaccggcagaaaggtgaaagattaacccggttgcggtcattacgaccaggactaaggaagaagtggcggccgcggtgaccatgtcggatcccatcacgagcagtccggcaaccaccggtccaccaccactgagcccgccgacaccaaccattagaccactgatgacaccatagactggtgccaaccatttattaggattttggtgatccttttgtctgctaaacaacgtctggagccctaaaatcgccaaaatccccccgataatatacaaataaattttgaccgggatatatggtgagatcaaggatcccacaaccacagctgggactgcaaaaatgatcatccgccaagcaatccgtaatttaattttgtgtagtcgaaaataagagtacgagccgattaacaatgatggaaacgaggtcaccaatgaagtggcggccgcgcttgctggccccaagccaaagaccgtcgtgagaattccaaggtaaaaggcggccccgccaccgccgagggtaatcacaacggtgccgatgataaagccaacgataatcagtaacagaatgttcatcaagtcattccttccaattgcaataatgtgattattgtacaccttgaaatcgtgctgccatcatccaactgaacactattttaaaatgatttgtatttatcacaaaattgggactactttttgatgttctgttgaagaaatccccccacatttttctcaaggggccatttgtgtgatacatttaacatgtaaggtttttcgattccaatggaaatagtggggtgatatagaatgaatgagaaggaaaaagctcaaaacgccaaacgagccaacatcatgtggatcatgctgtcactgatggtgctgattgtgattgccggcatcgtcgggattatcatgaaaagccatcaaaccaaccaatataaagatatgattcgacagagtattgtcgcttataacaagaccgatccagaaacgaccctttcaccaaccagcaaaacaaaagtttaccgggtacgtaaatcaggtgacggtcagttctttgttcaattgaatggcacttcaccaaagttcgtctaccaaaagaccaaaggtaagtggtcatcggttggcacccaaaagaaagccaatattgttctgaagtatcgagcagtttacacttcaagtcaaccatcaatgggaagttaatttgtatatcaaaatgaggccgggatacaactgattgtcagttatatctcggcctctcttgagttccaatggtatgaagtttaaacgtgcaacgatcggctgatccccgccatttaagcaaaacgcctcgcgttccactcttatttatttaatcggcttttgggtcgccaaaatctcatcaattttcttaagttcttcactagaaaattcaagattgtccagtgccttcacgttatcaagcagttgttccggtcgactggcaccaatcaaaacgctggcaatttccggctcacgcagattccaagccaaggccatctcagccaaagtttggccacgatcagcagcgacctgattcaatttcttaactgtcttaatggtctcttcgacctgttcttcatgaagaaatggactggcagatttgtgagcccgtgaatcagctggaatcccatttaaatatttgtccgtgagtaaaccttgagccagcgaactaaagctgaccgctgccttatgttctttcttcaataccgggaagagatcattttcgatgtgccggtcaaacatgttgtagcggggttgatgaatcacaaacggcgtgttcaaatccttgaagatcttggtaatctcttctgtttgtttgccgtcataattggaaatcccgatatagagcgctttaccttcatgaaccaactcatccaaggcaagggccgtttcttccagtggcgtgtccgggtcaaatcggtgagaatagaagatatccacataatccaatcccatccgcttcaaactctgattggcactggcaataatattcttccgtgatccccattcaccgtatggacccggccacatgtaatagcccgctttgctggcaatgatcatttcatctcgataaggcttcatatcttctgccataatccgcccgaagttctcttcggcactcccaggttccgggccatagttgttggccaaatcgaaataggtaatccccaaatcaaaagcttgatggataatcgccttttgattttcaaaggaatcgacactaccaaagttatgccagagtccaaggctcaaggcaggaatcttgaggccacttttgccaacccggttataaaccattttatcgtaacgatctttggatgcttgatacatttcgccatctcctaaattgtttagcttaaatgtaacacttcgagtatacttgaagtaaacttatttcgacttgggaggtcaactgtttgaaaaccgcaaccgtgaaaacttattcgatcaccgaagtatctaaaatgtatcacttgccaaccacgaccttgcgttattacgaagacctgggcttactttacgacatcccccgcatcaagggccgacgggcttatactcagcagcacctcaaccgcctgggagcgatttgctgcttcaaagataccgggatgacactcaaggaattgcaggaactgtttgccgcccaagacgacgatgcggacttggacaaaacctgtgacattttggataaccactatcaacgcgtccttgaacaactggcgcttttgaaaaaaaacgaacgtcacatcaagcgcaaggtcagattttatcatgacattcgaaccgccaaggagaaccattcaaagatgccggattgggatgactatcgggatcgggacttttaatttgctggattttccatagtatgtgtaattgccggtaacttgttattggctaattttgatcggatgacaactattccaaccagggcataaacgattgcgacaataatcgatccgaccactgaaacattcccagacatatttgcagtagaggtagaaccagtgctgatctgacttaaatacaaaatcggaaagtcaattagaaaatgggcaaaaatcgtcgtgattaatgatccggttctcacataaatcgctgccagcaaaatccccatcccaaaagtttcaatcatctgacaaactgtatccagcaatgactgatttgccaaattgctcaaatgctgtaggctgaacaacagacttgataaaccaatcgtaattgcaacgctacgcttcgtcagatgacgctgagtgaggcgtttgaataaatccccaaaaatcactcccctaaagagcagttcttcagaaatcgccgtcaacaacgtccacagtataattggaggcaaaagtttcaccggtcctgatgagataaacaggctaatgtagacaataccaaaaaggaaaaagagagttgtctttaaggtaacattaacggagaaatacaacttctgtttgattagccagatatttaaccccaaaactagcaacacttcgatccctttgtacaaaatattgctggtaagatctccaaagggcagttttaggagtactggaactaatatgccattctccaaaaatttctcgataataataaatcccactagcatccaaatccactttctgggattgttgacccaattaggtttattttgtgttatcatgcggcacctcgcttggaaagtattttgattctacatccaatatacaaaactttactatctttaccagaaagcatttgttgcgccccccctaatttcacattaggtttgcgttattggtttccggtttctctttttgtgagtgaattttgcatttggtttatccagcacataaaagtagcgccatggaagttaaatcccatgacgctacttttatacagaactatttaggagtcttcgaagtcagttccaattgatcccagaaagttgggaagaggtagttgttgtaggccgcctgcttaaagttctttagtcggtggttaaccggcgtgaaactcagcaaggtgctttgaggcgcataagcggcttctttgttcatataaacctgccacttcttaaattgcttgatccgatactgctgattccaagctttattactattcaagctgttgagtaacttggtgttcttcttggtcacaaagtgtcccatgttataagtggcatcttcaccatagaactgggttggcgttggttcataagttaactgccagccgccaacgaagacgtcaatctgcttttgctttggcttgcccaagattgaatagaagctgttaatctcaagtggtcggccgttggtcatttgaacgttcagacctaatttccgccactgctgaacttcatatcgagaaatttcgttgctggcagcggacccctgcatcgcgccgaagtgaatggtcaatttcttgccgttgggttggacgtaccacttgcccttcttcttgtaaccggcgtctttcagcagtttcttagctttcgccatatcatatgggaacccggctgctttattatcatgatatttcttgaaaattggtggaatcaaggtatttggccgccattgaaccccactcaataatttcttgttaaccttgtccaggtcaactgcgtacagcatggcctttcgcaggttcttgttacccattttgctgtgcttatccatgacattcttgttggtcttggtgtcaaagtggccaacgttgaagccaaagtaaccataacttaaaccaggtgccccagcgagggtgtagcctttgatattcttaactgatttatattgactggcaggcaggccgcccaaagcaaagtcgaactttttcgccttaaacgccgctgcagcattgcttgaggaaacaacttggatattgacgtgcttaatctttggctgcggtccccaataatatttattgggtacccaagcagtcgactcaccttgaacctggttttgcagtttgtaaggtccaacgaaaattgggtgtttacggactgcaggtgaggacgataacttggaaatcttcacattcttaatgtgctgataaggaaccaccgtcccccataagaatgaattgccggcgtattgcatcgcaggggataaatgggtgtagtggatcaccacttgcttgccgttttgtccatcaggataggtaatccctgaaatctgtttcgccttgccagtgtgataagcagccatgcctttaatggttgccatgtcagatgagtactgttcagcgcccgtattttgattgccgatgatttcataagcgtactcaacatccttggcaattactgggctgccgtttgaccacttggcgtttttccgtatggtaatcgtagccgtgttattcgatcggtccagcttcaagttcgccaggccgcccttgacaatcttaaaatctttgttgcttttaaacaactgatcgccaccacctggtgaatagacatcagaatcctcaacgttatcctgtagtacggcaagtgtaatcccggtaaacggtgcgtcaacgacttcagcagcgttcagcgtactatcatcgtctgctttgcttgcctttccagtcgcactataagttgtcggcatggaaatgggcttggattgggactcggatgatttgttgttcgaacaggctgcgaatgccaatgtcgacagactaatcgtcccgatcaccaaccacttcttaacatttttcatggcaatatctccctcgtgaatattatatgaaaatgagatagctctaatattattttaattatatatcttgaatggaaggtattgcaacacgcaaaccggaaaccaaacaaaaaaggccagagatttctccccgaccagatcctagtgattgcaaaatgtttttcattaatttgggatttagctcccatataaataataccacacatgggtaccttttaaacacccgtggactgaagtaatctttcagcctgcaaaccttgtccattaagatttagcacttagttactgaaagcggtagcaaccactcataatctatggtactatcgatttgaattattccgatatcgtcagaggagcgtgaaacaattatgaattccggagaaaaacaatccttaatcaaagccgtcaacgaagcctctcctgaggggcttcggcaattcataattaatcaggcgcagttcgatcccacattttttagagacgtgaccgcccaatttggcgatctcgacacggatgctgagttggtgcaaaccaagaaactgattcaaagtacagtccgtaaaaacaaatcttacggctttattgattaccaaggctgcattgttgtttgcaatgtcttggatgatgtgatcaataagtacatgctccggttcagacaaggccattatcatcatgcaatgaatggcttgctgttggtcgtggaaacggctgcgaaaatgctcagcgatgccgacagcagttccggtgccttaaccgacacgtttgatcgtgtctttggttcgatgaagaacttaagcaccaatatcgcccctgagattttggaatcacaaaaagaaatcgtcattaaggacgtggttcgcgtttttaagcgaaaaatatttgccggctggcccgaacaacgctatcaggtattgtataatgccctcccgctgatcacgccaaagtctgccaagcttgctcaatccgcatctcgggcagttatcaaagcagccgacgaaggatttgaaacgactcagtctgaaatttacgataaagtgcttcatgctcggatcctgattcaacttggagagcagtccgatgccgagaagtttatggacgagcataaaaccattccgcaaattcgcgaagtggaaatccaaaatgcgattcaaaacaaaaactatgttcgagcagaagaactgtgcctcgaggcttcaaaacaggaccaggggtggcggcgaatttgggagcgatatctcatcaaaatttatgacgctaccgatcagcagcaaaaacaagaagcggttctcgaaaaccgtctgttcgcaaactaccccgacgcatacgaaccactcaagaaactgcgacaacaggataagagttgggatgcccaatatccggctttcctggctaaagcggcgaagaaactgacaccggaaaactatgccttcatcttagacaaggaacgtgaattcgataagctcatgcagctaatcatgcagaaccctgaactcactgaaacttatagcaaggacctgtaccctaactacccagatgtcgtcaacaagctgtattaccaaaacgttgttctgaacgaaaaatatcccggcagacaagcctatcgacgaatgggccgaagaatcaaaaactataccgcattcggcagcgtgcaaaccgctatcaaatggatcgatggcttaatcgatgagtatccatccaggcctgcacttgctgaggaactgaataaagtgaagaaaaaattacaataatcggtaaggctgagacctcatcttagacttgttgaatccgactgttatcgagaataaacgtgaaacgatcggctaaaacacaatcaggccatcattccaaaactaggaatgatggcctgtttacattaaattatgagatcaaaacgccgtgcgtctgactctcatgttagtatcaagttaaattaccgtcggcgatgtttcacaaccgtaaagaaatgaaggatgcatcccaacaacacatagaagatgacgacaaacgaagcgtagcgccaccagaaatcagcagtggaaaccaaacgcaaaccaacttgaattcccatcgtcaataacgccatcacagcaaccataaagaataattcaatatatcgtttcaatgtactatcatctctcttttgttcagtattcaggcgggcaccccatttgaggcaggcctgttttttgttctcgggcaatgccttcattccccaagtgttggtcaacaccagttcgtgaattttaatcacaccagccgccgacatcaccttatcaatggttcgaaaactttggtcggtgacgccggttacccagttctcgaaggttccggtataacaatccgtgatgctcaaatagtgcttattcttgaaccggtccggatgggtaccaccctcatgatcaaagcggaccaggcgttggcgcatgcagtcaaagaagtctttcatcttccctgctaggccaccccaataagtcggggctgcaatcacccaaacatcgctttcaagcatctttgcttcaagttcatccagcaccggatctttgtgatctccctgatccggcttgaatggatagtcttccaaatagatcatgtcagtggtattaggcgctttaaccgcagacagcacggtttccagcatcatgtccgttgcgccgtcatttctatgagaccctaaaatgccaagtattttcaatccaactcccccttatctcttaaatattctaaatacattgattaaaaagcagcaatcacaaactgcaaattcaaaacggtaatgatcgtcgtcagcaggtagccaatcatcgtcacataccgctggttggtgtgaacccccatcaaatcatggttactggtcaaggcgaccatcgggaacagtgtgaatggcaaggcaatcgataacgcaatttgggcatagacgataatttgttcaaaatcgtgatcgttaaatccaaccagaaacccgattgctaaaatcggaatcagggtaacaaaccgggtcagtaaccgacgctcccaaagtggcagacgaatatgaagatagccttccatcacaatttgcccggataacgtactggtgattgaagaaatcatcccagtgatcaataacgcaaacgcaaacaaggtgctcatcaacgggctggcaaggttgccaacgattgccgaattcttcaagccgttgtaaacatcctgaaaggccgacaactgcccgttcgtgtggaaaaatagcgttccgccaaggactaacaacaaggcattaatcaaaaaggcggccaccaaatgaacattggaatcccatttggcaaatctcaaagcttcattaacctgggcgggattatggtaatcataccggcgactctgagcgagtgaagaatggagataaacgttatgcggcatgatcgtcgccccaacaatccccaaactcataatcagcatttcatgattagtcaaaatcttgggtgtcggcagcaggccaccagcaatttgggccagattgggcgttgcccgtgatacctcaactccaaagatgacaccaacaattaaaatggccgttaacacaataaattcgattcttctgattccaaatcttaaaaataatagcactaacaatacatcgaatatcgtgaacaaaatcccatataacaatggtaaaccaaataataattttaatgcgatggccgtgccgacgacgccagtcatgtcagttgccatcatcgccaactcattgatgatccacaacgtgtagcgaccggctttaggcactttctgggcaattgcctgggcgagatccagccgggcaacgacgcccaatttgatcgacaatgtctgcatgaacatggccactaaaatcgacatcaataacaccgacaaaagtgaataccgatattggctgcccccagaaagtgacgtcagccaatttccgggatccatgtacccgacggcgactaacgctccagggccactgtatgcaagaaacttttgcacaaatgaagtttcataaacgctgggaacctcgacactttgattaatttcatcaaggcttttatgcgtttgctcttggctcatcggcctcgcctccccgaagttgtttaacactgaggtcggctaagaattggcaaaaatcatcgctgccattcattggtttgactgagtcaaagacgttgccgccgcttgccttgaaggtctgatagttttgaacattattttcttcgatggtttccaaacaatcttcaacgaatgatggcgtcaccagtaacacattgcgtttacccattgcggccaactccatcaaataatttttcaaataaggtttgagccacggcatcggtccaaatttagattgaaaaaccgttttgactttgtcactcggaacctgtttaacgtatttcatcacaccctgagtcgtggcgagacactcaccttcgtatgggtcaccttttttgaccatcgacattggaatgccatggtagctgaaaatcaccgcatcatactgtttctttgggtaagcctcgtcaatttgccgggccaaaatctgttggtacaccggctcatcataaaagttcttaataatatgagtcgcgactcccgacgactgaactttttcaataatagtatcgtgggtgctttgtgtgtaatccggaaacagcggcaagacaacgatgtcacgatcaccgcgatctttcatctcgtgcaaaacatcgacaatcctgggttgcccataattcatggcgtattgaacgtcccaatcaggcaagtcctgttgaaccttttgcttcatgatttctgtgtaagccgtcagcggtgaacccgctttggtccacatgtgctgataaaaggttgccgaacgccaagtgcgcatcggtagaatcatgccacgcaaaataggctgccaaaaccacttcggcagcgttacgacattttgatcactcaaaaattctttcaaataagctttcacatctgcattactgggcgacactggtgagcccaaattcaccaataacaaaccatttttcgccaagacgatcccctcctcgccatatatgtatattttagaggtttcctatgtgaaacacaattcaatcctgatcaaaattctccatatcatctgaaaagttttaggttttccacttaattagccacggacaatgaaattgagtggcatgttgggtacaatggaagaaggaaggacgtgataccttgaacgactccaaagaatacctggacttttttaaccagacctataatgaccctaataagcacagtgggtacagcaccaatagcaatctgcggtttgaaagtcgggcagatgccctgcaggtaaaaaatatgctcatcgaaaaaagtctccacgccaaattttatgactttagcgtggaatacattaaccccaacaaatcgatgcaggtcggctggtacatcacgatcaaaaaagtcgaccaacagccaaccaagccgcatccaaaaactcaaccccaaaataacgatcagcaaacaaaaaaatagttctccttttttcgtaactataaattgtcgcgcaaggattaaacatggaggtacaaatattgacaaataacgcaattccagaaatcactttaaacgacggctacaagatggccacgattcagtttggaacttttcaaattcgcggtggcgaaggtctccagcagacactcgctgccatccaggacggttatcgcggtttagataccgccaccaattatgataacgagggcatggtcggcgaggcgattcgccgttccgggatcccccgttcggagttctttgtgacttccaaactgccgggaaagtatcatcaatatgacgaagcaaccaaggcaatccaggaatctctctaccgtttgggattggattacctcgacttatatttgatccactggccgctgccgaaacgtaatcactacgtagaagcatttcaagcaatgattgatgctaaaaaacgcggtctgatccgttcaattggtgtttccaactttgagccggaacatttggacagattgattaacgaaaccggcgtcactccagcggtgaatcagattgaagtccatccctattggaataatgaacgcatgttaaaagaggaccagcagcgcggcatcgcaaccgaagcttggagcccattaggccgagggagtgccgcattgaaagaaccattaattcaagagttagccaaaaagtacaataagaataccggccaaatcatcttaaagtggcatacccaaagaggcatcatcccagtgccccgttcaagcagcttaattcaccagaggacgaacaaagacctctttgatttccaactgactgaggatgaaatgaaaaaaatcaacgctctcactaagccggatggcagagtggatgggcaggatccgaatgtgtatgaggaatttgattagagtgttttgagcaacgggtgaggcgttttctaagggtactctgattaaagtccctggtcttgggactttagtcagagtacccttagaagttagcctcagttgctcaaaacacgtttcaactatgtaacatttcaggcacttcctacaccacatttgccaccccaccacattccatgttaatatagtcaaccttggcactaacaaattccaagtaactcaattcatgtatcatcacctgaccagcaagtatcaatgtgctggcagttttcatgtcaaaaaagaggggtaaaacgtgaaaatcaatcaacatttactaacaattacaggcgcgctggcactcatcttggtgctggcaggatgcggcaaccaaagcaccaaaaattccagcaaccagatggccaaggaccaaactgtcaatatcagcaccgattcagaaatctcgacactggacactgccaaagcttctgatagcggcagtttgacaccactttaccaaattggcgagggaatctatcgacttggtgcaaaatccaaagttgaaaatgccctggccaccagcaccaaggtttcaaaagatggcctgaaatatactttcaagctgcggaccaatgataaatggaataacggtcaaccagtggtcgctcacgacttcgtgtatggctggcgtcgggtagtcaacccaaagactgcttccgggtactcttacctgtttgaaggggtcaagaactacagtgccattcaaaaaaacaagctatcgccaaataagttgggcgtatcagcccccaacaaatcgactttagtggttcacctgagccatccagttccatatttcaaattattgctcgcctttccaaccttcttcccacaacaggaatccgcggtgaagaagtacggcagcagttatggtaccagcagcgccacaaccgcatacaacggaccgtttgaactcgccgactggaatggaaccagtgatacctggacgatgaagcgcaatcctaattattgggacaagcaggccgttaaactcaacaagcttaagttccaagttgtcaaaacgccaagcaccggactttcgctttaccagcaaaacaagttggatgttgtgacgctttccggcgaggaggtgccatcctacaagaatcggcctgagttcaaaaagtttgtcggcggctcaaccatctaccttgaaatgaatcaaaagcgggtcaaggccttaaagaacgtcaaaattcgccaagccttatcccaaattatcaataaacaatccctggctacccaagttctgcgtgatgggtcaaccgcaccaaagggattcgtctccaccaacttcttccagaatcctaagactggtgccgactttgccagtgacgcctatgaaaaatcaggggttgcctacaaccaaagccaagccaagaaactctgggcagccggcctcaagcagactggggtgaagaaactgcacctctcactgctaagtgatgatactgatcaatccaagaagaccacccagtatctgcaaagtcagttcaacaagttaccgggattgagtattaccatccacaatgtgccaactaagagcaagctgtcacggtcaaccagcggtgattttgatctggtggtttcctcttggggtgccgatttcgctgatccaatcaatttcttggacttaatgactaagaataacccaaccaataatggtcactgggctaattcacaatatgatcgctacattgaagcatccaaaaccactgatgcaaataaccgcaccaagcgatatgcggatttggtaaacgccgaaaaagtcttgatgaaagaccaaggcgtcattccactgtatcagccagccacaactcagctctggcgaaccaacatccacggatttgtgtggaatccagccggtatgagtaatggatacaaaggtttgtatgtcaccaaataacactaaaagagcattcggaaacctaatccgaatgctctttttgtcgacattaatgctagattgctacagcacgattcttaattctgactgcctgttcaaagttatcagtaataatgccggcgacatgatccgccaacaatttttcctgcgttcgcggatcgtcgacggtccaaatccgttcgtcaacgttggctaatggttggtaatgactgagatgcagtccagccaaatgctccttaacgattaatgacttaggattcttaatcacatgatccgacaacaggcaatactgctggttggggtcgatttggtaagcaattttgagcgaatccaggttaaatgaggagtagataaccggatacatcaggtcgtattgcttgaccagatcaaggacaatctgttcaatctttgggtagtggatcttgttggtcttaaattccaaattcaggtgaaccggacgatgaactgccagagccaaaaggttcttcaaagttggaatggtttcaccatctcgcatgtggaactgttgcagctccttgagggtgtatgagttgattaaacctttaccatcagttgttcgattaattttttcgtcatgcatgatgaccggcacgttgtcctttgtcaggtgaacatcaaactctaagccgtcgatgccatgatcaatagcgtactgaaatccttttagtgaattctctgggaatttgaacgggtaaccgcgatgcccaaaaattaacgttttagtactcaaaatgggtaacttcctttcaattcttcaactctcttaacgactttccctttaagattcagtcgtgaaccttaatggaaagtaaatccaaactacccgccatccgctttgttggtcgtcttcaagttggcattcatggccttgttggcagtgtttagggcactgttaatattctggccattgtagacgccttccatcgcagtttcttccaattcacgggtcaactgcatgccttccatcaaaataccagagttagtattgttgggtttggcactggctagttgttcaccgggaactcgggcagccggaatctttttgtacaaatcttgtaaagtcttggtcttttgagaattcttgtttaatgccaagtagccggttgccttttgccagttggcttgattcttagctgtttcagcgaatttaatgaattcccaggcaccgcgttgggtcttagcgggtttatcattcgagatccaaagcgcagccccaccaattccaacaccattggccttcacaccatccggatgtgggaagtaggaaattcccagcttgttcttggtaccggtggtcaactggccgatataggcagatgattgaacgaagatccctaatttgtttgccaggaaggcggcaatttcattggtttcggcactggctccggatccataattgacgaagtcaccggatttaatgttggctctgatccaggtcaggaacttcttagttgtcgggttattcaaatcaatcttggttggattgccagtgtgaccatcaccattgttaatcaatgatgtgtgggcattggcaagggcttcttccattagccagccataaatttccatggtcatgcccttcaccttgtgatgggatttggcatacagttccttggctgcccgggtcacgtcactatagcttggcgacttggacggcggggtgacaccatacttcttgaacaacgaagcgttatagtacaacactggttgagaagtgttaaacggcatcgccagctgagtacccttattagaatagaacgaacgggcaactggtgaaatgtcactggcgtcatagttgtcttcatcgatgaatttctgaactggggtggtgtacttactgtgcatcatctgggcagttgaaatatcaaacgactggaacaaggcaggcgaggcgctggttccgtggctttgaataatcttttgaacggcctcatcgtaggcaccttggtattggggaatgacttcgtatttgtcctgagacttgttgaaatcatcaaccatcttatccaaagcttgctcagctggaccgcccatttcgtgccagaagacgactggaattcgtccggctttggcactgcttgcgttcttggagccattcacaaaggcgatccccagaacaattgcaaagatcgcaaagattggcagtgcgtaagttttgagaaatgctgttacttttttcattatttaaccgcaccttcattcacaccagatttgaagtaatgctgaccgatgaacagcacaatcagcgtgggaatcacaacgattgcagctgtggcttgaatcatgccccagtcgttaaaggtttcttctgactgaagttggcgcaatccgttctggactggtcggaaatcattgctgaaagtcgtcagcattggccacagatattggttccaggcacccagaaaactgtaggcacctaatgtcatcagtggaattcggttgtaaggcaggaccattttccaatagaactggaagtggcccaagccttcaatatcggcggcttctttaagttcaatcggcatctgcataaatgattgacggagcatgaagaccccgaatgccgatgtcagaaatggaatcaccataacggagtaactgttgagcagccccattgctttaacagtctggaagttgggaataatttcggcttcaaatggcagcatcatggttgccaagaacaggccaaagaggaatttgcgccctttgaatttcaggaacacaaaggcgtaggcactcatcgaacaaaagatcagttgggcaatcatggttgccgtggaaattaccaaactatttcccaggtacctgagaattggcgtttgagtaaaggcatcaatgtaattctggaaggaaaccttggtgcttaagaagtttccctgcgcaatctgcatggttggcaggaaactggtccacaaaccaatcagaaacggtgccagaacaatcaccgcgagaatcgttaataaagcgtagtcccaaattcgccgggacaattttggcttggtcacaagatccattagtaattcacccgcttttccaaaactttaaattgcaggagcgtaaacagcgcaatgatgatcgttaagatgatcgattcggcactggcttgtgcatagttaccgctgtaaaacgcgtccttgtaaattcgataaaccaacatgttagtagcgttggtcggcccacctttagtcatcaggtcaatcaacccaaagctcttaaatgattcgatcaaagtaatgatggaaacaaagaacagggttggcgaaatggatgggattgtgatgtggaagaactgaaatcttgatgaggcgccttcaatgttggcggcttcgtacaaagtcgttggtacagatgacatggcacctagcaaaatcaagaaggtaaagcccaggttcatccaaacggtggtgatgatgaccgcccacattgcagcagttggatcagtcaaccaaggaatttgtggtagatgcatccaagtgctgaccagagaaaggaatccagttgatgggttaaaaataaatagccagaagatggcggcaacggaaacggaaactcccatagttgccgaaaatagtgttcgaaaaaggccaattcccggcagccgtttgctagccaggtttgcgagaaccaatcccaaagcgatcgtgataatggtcaccgcgaaaacgtagaataacgtgaccccaaggctggatagataatcagccgaagtcaataaattgatataattggaaatcccaacgaacaccgttggcttaccaaccgtgttggtgaggaacaaactcagataaagtgtcttaaccattgggtagaaaatgaaaacgcccaagatcaaaagtgacggtcccagaaatgcccaggcaaagtacttatccttggcatttaatgtgaacttagcttcctgttcagcaagcttacttttggttttctcaaccgaaaccgggcttgtcggtgtgctttgtgctggagatttaagcatgaacataggcctcctttgaaaggttcattcgcttgccttctgtatcaaaaaacatcaggttggaatcagcggaaactttaattggctggaaaattcggtaattgacttggccaggtacaacgacgtgaatgtcttcgccactattcaaggtggcgtagataatagtttcgtcccctaagaattcggtgttcttaacggtggcgttggcttcaacactctcagctgcctcagctttcatatcgtcaggacgaatgccaatcttcacattttcagcgggaacttcttcatccaaagcaatttccaaatcagaagaaacattcaaaacatggctatcggtttgcgaacgctgggcattcagaatgttaatctgtggggtaccgaagaacttggcaacaaaatcatttgccgggttttgataaatctcactgggagttccaatctgttgaacgtgtttgtcattcaggaccatgatgtggtcggccatggtcattgcttcaacttgatcatgggtgacataaatcagtgtcagacccagtttgcgttgtagggcataaatttcttggcgcatcttaattctcagttgggcgtccaagttggatagtggttcatccatcagacaaatcttggcatcactggcaaccgcccgggctaatgccactcgctgtcgttgaccaccggataactcacggggtttgcggttcgcgagttcagttaagttaaccatctttaaagcttcatcgacccgctgcttaatgtctgcctggtccattttgcgggccttcaaaccaaacgcaacgttatctcggacattcataaatgggaaaagggcataattttgaaagaccatcgttaatttccgagcctttggcggcaagtcattaacgaccttgtcattgatactgacttcgccggcggtaatcggtgttaatccggcgatcattctaagtagcgtacttttaccacatccggatgggccaacgatgacgaagaactcgccagtttcgactttcaccgaaatatcttttaggacttctgtctgcgcatcataatctttgcggacgtttcttaaagtaattgacaattatctcacctcaaaatcatttatttcgttacaagatttattgtgagggttcaatgtaaattgccagtttcattaatgtaaattgaaagtaaaaaaatgataatgaatgtaaaaatttcattttgactttgtataagatcaaattgattgtggtataaccacatattagccactcaaaatccaacctgccagccattttttgatattcatatattgaccgtcgaataaattcaaatgaatttcaaatatattttatcgagaaatagatattgatattcgtttatcgatatgatatattcgatacagttaattaatccagattaaaagagagaggctgatatccatgtcaaaattattagatcgcagtattggtgccgtttccgtcctgatgcagatcgccttcgttgttgtctgcttcagtttcattacgccgtttatttacttgtataacggatttacccatgccaatattatgaaaatgattgccaacaatggtgatttcttaattgttcccggacacacccaagtaactcacagcgctgttgcccatttcccaattctcccatactcggtcttaatggcgattggaattttcttagccatcctctctgccctgtttgccttttcagcatttattcgaatcagtcataacttggggaaaaagcaatactttgtggctgataatttagcaatgctccgcagaatcgttcatgcccaaatgatcgcaatctgctcagatgtctttcttgcgatcggaaatcaaatgacccagtcattcttaggccgagtcaataacggtatatttaataatacgtgggaaaatttgctggatgatgcggttatgctggtatttatcgcattaatctacacgttgtttagaatggcaatgaatattaagcaagaaaacgacctcactgtttaaggaagggggaatataattgatcaaaattacccttaatgttgtcatggccgaaagaaatatttcgactggtgaactagccaagaaagtgggcattactcccaccaatgtttccatcttaaaaacgggtaaggctaaagcaatccgattcagtacccttgagaaactctgtaaagcgttggactgccaacctggagatattttgaaatatagccctgacgaagaatagagcttcatccgtcaccgtcttagagcacaaaaaagtgcaaaccgcgttttcggtttgcactttttatatcactatcaattacatcacttgtaaacatccatcaactttgcaaagtcaacggtccccaacccgctcgcttgattataaacagtattgggttgaccagtataatacagatttgaattattctcagtgtcgttcagtggttgcagtggtgaatccgatttggttgccagttgatacagctgtggattccagaaacccattcgcgaatggtcagcttgactgttaatcaacgctgccacccccgcaaactgtggtgaaacaatgctggttcccccgcttatctcccagccattagaggtgctcgtcttttgatacgtgaagtaaccggtagtcgcatctgcattcgctgagatatccgggtagtttctgccatcatcagttccggaaactagtggtgcgttatagactgggccacttaattgcgacagatactcgcgggcattaaaggtattcacaccgggaacgccttcttgataggccggcgtctggtagacgtgactgaacccgccgccaccgccgtcactaatgtcgttgaagaattcaggcattgtcagcaggtaatcatcgttaacctgaaggaacggccaccaataatcgctgccccaagctcgttgcttttggttggagattgtgccaattgatttgccgtttggagcaacggactgcttaaacggtaagctggttccgccggccgaggtgatccaaggactagtggtatacggatcggcgtcactgattttccggtccaacaaaacatcatttccatgaatgccgaccacggtgtagttcaaggcgccgctgtcaccggaagccacaaaattggaaatcccctggagtgccgattgtgcaagcaccaggttcaacacctcaacatattgggatggcaataaattcattttctccaaaatctggaagtagttgttgggtcccatcccccaacttctggaaatctggttgacactgccatcgtcgtaggccgttaagtaagtattaataagattgattaacgttggaatcacagaaccgctgttaaacattttaatgttggcttcaggcgccacagatccggcatattcagcatccatcgtggcttctccgtcgctggtcgatttaatatctttccgataattatcaccaagaactttcaccatttggaaccgggacttggatgcatttacatgttcatgccgccaaaagtgcgtgaggtcactggtttggacattgccaaaagaaaccaggccaatcgtctggcccttgcctgtcaggccgtgatcgtaaagctggtcaacgccataggtttttgtaaaatgactggtatagccggcatttttatcagccagtgccttagtcgctttgggagtactcttaaaggtaacgtcagaatccgggaaccagaatttcttgttatgattggccattcccatcactgccagaacggagtcttgcaggttggcgggaatgttgggtttggatttaccaaattggagcgggtccgagtgataggtggcatcgctcaaattcgttttgaacaagcgattcacatccttggtcttcccctgcacattcaacaccaatccatcctggtagacgtgagtggtcagatgattctttttaaacaaggcaacccacccattgatgacggcatcaggctggccaaactgctggcgaatatccgaagtgctcagataattcttaaaatcagccttggttggatcattgacatccaacgccttttgataataagccgtcgagtcctgtggcttcatgacaatatcgaagctcgcggtcgaattggctttcagggccgtcggtttcattcggttcgccataatcatattttcaaaaatcgtcccgaaggcatcgacggtcgaagcggctgctgaattaaacaaagccagtgaaaataaggccacaaaaccaactaaaaatctgcgaatccatttactcatctcatccatccccctcagtgtcctcatggtgctctatgaatcgattttagcacgaaaacagtgattttctgaacagttggctcacggatccaagacaagaaaaaaagcatccccacaacactcagtgtcatggaaatgcaggtaaaatgatcagattaagcagtgacgtttgctttaattttttcagcaccttcaaagttattggtgaaaataccggcaacgttgagtccgaatagatgcttttgcaccttagggtcatcaacggtccagatccgttccttcacgtggcgcattgggacgtagtgactcaaatgcaagcccaccaagtgttcctttgccatcaactcacggggatttttaatatcttcttccgacaggtagcaatactgctgagtcggatcaagcttgtaagcaattttgagggagtcgaggttaaatgatgagtagatgaccggatagaccaggtcatattgcttcaccatgtccaggacgatctgttcaatattgtcatagtggatttcgttggtcttgaactccaagttcagatgaaccggttggccatttgccagcgtcaataactctttgagcattggaaccgtctcaccatcactcaaatggaactcacggagctgctttaaggtatatgagcgaatctcgccggttccatccgtggttcgatcgatcttttcatcatgcataatcaccggaacgttatccttagttaaatggacatcaaattccaaaccatcgatgccgtgatcaatcgcgtacgcaaagcccttcaaagaattctcggtgaacatatggggatagcctcggtggccgaagatcaatgttttacttaccattgtgtgtaaaattgcttccttccaaataaatcaagtatgtgcgatcaacaatgccgcactcgcaccaatgcgcctatcataataacacgactggcgagacattcaagggaatttgaactaagaaccgccaatctttcaaatatgaccaattgatgacggcagcccatcactgacaaatggttggtccaaatcaaatggaattggctggtccaacgttaaggatcccggttcgacctgacagtcataggccaggacgtgaacgccatttttttgcgcctttgcaattgccaccgccaggtcattaaaaatatcacggtcaatggtcattttatgaatatttttcatttggatgacaaataataaataggcgaaatatccagcctgagccgccttttccagggtcaacacgtgctttaacccacgggtggtgggcgcatccgggaatgcagcgatcccctgattggccaaggtcacccctttgacttccaggaagaatcgttggcccaaattgccggttccggaaaaatccaaccgggagtccaaataggtcgtctccgggttaacggtcgcaatcgattcgattcccggcagttgaatgtaattgctgattaaccctgatttaaccactttattgggcgcctgagagtcaatgttaatccattggcgatcgtacttcttggcggccaccagatcgtaggctgtcttgcggttaggattgtcattatgcaccagcgctgtcgtcaccccaggttggagaatggttgtccggccggtatttttcacgtgaacggtcacgacttcaccagtttcgatcagtcgacaatgagagatgaatcggttgggtcggtcgatgaatttggctaaatgaacgttaggatattgcatcacgcacctcgagactgtcgttttaaacttattactagtattatataggtaatatgagtcttgagggggaattcagatgtattcattcattaatcagattaaaaattatatttggctgaaaagtatcgcttacatagtcttcggcctgctgttcctgtttgacccacacgacacgttgaatatcgccattaatttaattgcggctttcttcattgtctttggggtgatcaatttaatttctgcttggcggcagcggcgaaataacgaagtggtcgactatagtctggcggtcggcattactcagttaatcgttgccgtcatcgtcttcttattggcagaaccactcttgtcatttttgccatttatcttggggatcgtcctgatcgtcacaggcatttccaacgtcttcaccgcgctcaatcatcgtcagtacgtcaacgtttcaccaatgccctttgtgttgtatggtgtgttactgatcctggttggcatcctgctggcatttaatccatttggcacaattctggtattactacagatcttcggcgcaaccatggtcgtgatggcgattatggaaattatcacttcttggaaactgggcatttagcaacccacagtaatagagcgtcgcttatgctgaccatggactattcattcaaattcttcttgtatatttcttcacattatcgtacaatagctctgtgaacggggcaatcatcactcgtcccacggatcacaagcgatggcttaacagctatcagccggggagtatcgctcaaacgttattggggatcatccaagagatatgtatcgaatcaagtttagagcatttagttcattacaagtgtgggggcacttggcacagcgcagatggcgttgtgctttttctttgccgatcccaggctgcccacaaactgacaacgatgttaaaaggaccccaccctgccctgaatcgtaaaatttttcaatgaatcgcttgggctaatgtaaacgcatacatttcactttcatgaactaatttacaaattcatgagcaaaacatttcaaatgtaatattttatgccctatactaaaggtggagtcaaagaaaagtgtctcaatcaactaaattgaatccttgatatcacaccattaatgactcttagaattgaacacagggagggcatgtaatatgaagaaaactttgaagaagatgttggaacgtgtatttaccaagaaggttcaagatgccggcaatctgcaaaccagtgaaagcaaccgactcttttggaactcagttactaaaggacaatgaaaatgaaagtcaagttagatagcattaagtaggcacctatttctaaatcatagaaatagatgccatttttggttcttgaggaattttgaagcttcaagcatggcagggttcaaccatttcccctgccacttggttgtttcacgtgtaacatctcttagcgctttttttgatcctccgccaacaattgcaataaggcctgatctcgattggcaatggcttccttacccatatcaccttcccaattgtagaatccctggccagacttcaatcccaggttcccagcgtccaccagtttcttcaagactggatcagtgccggtattattggccaaatcatcgtagaggtaactgctgatattttcaaaaacatctaaaccacccaaatctgcactggcgattggcccgaccaggctccaacgacggcccaaactgtatttgatgatgtcatcaaccgcttccggactggcaatgccatcatcgacaatcttgaaggcttcccgcaaaaccgccatctgaattcgattgccaacaaatcccagcgattccttcttcagggcgactgcgtgtttaccaatgtggttcattaaagccgttgcggtcttgaccgtcacttctgacgtctgctcacctggaacaacttctaccaacggcattaactgtgctgggttccagaaatgagtcaccaccaagttctccggccgctttagatcagcttgaatggtagttggactaagtcccgaagtgttggtcgccataatggcatcttcggaaacatagtgttcaactttctgccaaacggtctttttcacggctaacttttccacaactgattcaatcacgaaatctgcatctgccaaggcgtcagaataatcggtggtcggcacaatccgtgccaaaatatccgccttctggttgcctttaattagtccgttttcttcaaaagtggctagatcgtgttcaatcaaatccatcccatgatttaaagccgcttgattcatatccaggagattaactggataaccattcatcgcaaattgcagggccgtggcatgccccatggttcccgcgccaatattggcaattaccttaatctccttcattttaagtgccgacataaaatcgcctccaaattgataagccaacgttctctacgctgagtctaccatattggaggcgattgttcatctattcacatttgcaatttttaatgaccctgagtcagtaattcatcaaatttatcataaaaggcctggccgtcaacttcggtcacaaggttaattggccgtccgttatcagtctcaaacgtgcgacctgctccggcacctgtggtcaaaacatcaccatgaatgtcctttgactgaatcaaatcagggtactgactggccaccgtcgttaacacatcccacaggtagtaggttgagttagcttcataagatgataccaatgcgtaaccttgaccgatcaggtccatcatcgggtaacgccgcaagctggcccagtgctgctggacgtcggcatttaatggcacttgattggtgctttccagtccaaccatttggatatcgatatcggcatcaaagactgccttaacggcctcaggatcccaataagcattccattcagcggtcccatcgtgcttaggctccaaaacattgccttctgtccgcatcgtgccacccatccagtatagccgctggatgttatcaacaatcgtggggtcgacttcaagcgcccttgccaaatcagtcaatggcccggtcatcaccaagtcagttttgccgtcagcctgcttaagcttgtcaatcatatccaagtgagctggtttctcagccaacggcgtggttggtccgccgtgttcgttgagcagcgggaaagcatcgaaggaaaacgagctgagccgccattctttaggaaattgatgaacagcgcgagagttggaagccgcaactgacacctgagcgccgttgccgaatcgggtgataatctttcgtgaagctggaaccgatccttcaatgtagccgtcagcgtcaatcacccccacgccaatcaaattgacttcgggcatttgcagcaagagtaataacgacaccaaatcatcgacgttaccgtcatggtcaaagtaaacatttttcacgatttcatcctccttatctgttaagtccatcatacaggaagctgaatcgccggtctattcaaaatcagtcactgctgtcttcaacgcccaaattctcggtattccgccgccgcaagaccgcgtagaataccaaggcccagatgaccgcaccgactgccggcaacagtgaatcatgactgaagaacaggctggcaaaaatggcgatgaaaaaggcaatcgttaatggattggaccaacgatatttgggcatcttaaagccatccggtcgaaagtccttggaatgacgatacttccaatgggcaaccattgtcagcatgcacaccagaatgtaaatatcgctggaaactgaggcaatgaatgaaaaggccgcaccaagcgagttaaaggaactaattacgggtgccaaaagcatcatccctgccgaaaagaggacgctgacaatcgggatgccgctcttggaaaccttttggaacgccttcatttctttagcatgagactcttgagccagctgatacaaatgccggccggtggaaaaaatggcgctgtttaaagtcgacatggcggcagcgattaccaccaggttgatcaccgctgaggcgccgggaattccagccaggttaaagatttggacgaacggactttgattgggattcaaggtcttccatggggtgatcgccatgataatgattaatgaaccaatgtagaagagcaaaattctagcgatgatttggttaactgctttgggcaatacccgccgagggttcttggtttctgcggtggtgatgccgacaaactccattccctgaaaggcgaagaagaccattggaaaggccatgatgaattgatgaatcccatttggaaacattgtgaaaccatcggtcaagttgccccaagaggcgtgggtgccggcgggattttgatgatgggtaaagaccagatagacgccgatgacaatcagggctaagatcgcaatgactttgattcctgatagaaaggtttcagacctgccaaaggaactgaccatcgccaaattgaccccactcaagatcaccaggaatgcgacttggattaatggtgccggaacatcagggaaccaatatttgacataggttgaaattgctgtaagttcggccattccggctaggataagttccagccagtagctccatgccgcaaatttgcccaagcgttcgttgacgtatttgccaataaacgaaacgaaggtatgctgctcaggatcggaatacatcatctcgccaatcgccctcatcatcaaaaagaagaagatgccgatgaccaggtagaccaagatgattgatggtccggttcgatgaatcgtactatcagcaccgagaaacaggccggtaccaatcgaaccgccaaaggcaatcatttgtacggccaggttggataacccccgccgtgtaccgtctttattgacctcaattttttctgctgctaacattgtttgaacctccttggatgatgtaagagcactccggagacaaatgactggatttcatttgtcccaacaaaaaaacgcccctgcagtcaaatactgcagggacgtaaacacgtggtgccacccagttttatggtcaatttcacaatcggccaccttcacaactcgttaaccaaattggttaattaagtctgagatcgtaacgtgtcttaacgtaggcatcgcttgcacgtgcctaatgctctgagctcatcttcacaagattgactttgaccgcctctcaccaaacgcggctctctttaccaaaggatacttgctactcttctcatcatcgcttaatgttttaatttaatactaatattagcatcgattatgcagattgcaaggacatttttggggtcggtggcgtgaacggctgatataacagtgcctaaactaatgatttttttggtcggcctcaagattggcaaagtcaattatccgcgccttgatggcgtcgcgaacttctcgaaaaacctgtaattgttcactggaactgccggttgcagcggccggatcaggaaaaggccaatgttgacgggcgacttgcggtggcgttatcggacaacgtttctcggcatcactgcacagcgtaaccaccaagtcagcgtggtttaaaattgtcgggtcaatcagcttggaggtttggctagaaatatccacaccagcttcggccatgacttgaacagccattgggttgacgccgtgcttttcaattccagccgagaacacccgatagtggtcacccaaatattgtttgccaaaaccttccgccatttggcttctgcaggaattaccagtgcagagaaaatagattgtcttttggcccatttgccccttcccccttcggattctgttaactaaggttattttacgccattgctccttgttaatggtgaatttgctttgacaggataatcatttggtggaaaatgaaggtaaaagtcagaacgaggtgatctcatggccacagttgcggaattatttaggcagattcaagacgacccccaaaatcagtcgttcaccaaacaaggcattcagccgttgttccacgttgatccccaagcagaaatcttaatcatcagccaggcacccagtcgcaaggcccaagcatcgatggtcttttgggacgacccgagtggcgaccggctgcgggactggatgggattaaacaagacagaattttatcattcaggcaaaattgccgtcatgccactggacttttattatcccggaaaaggtgcccacggggatttgccaccgcgaaaaggcttcgctcaaaaatggcatccgcccctattagcccagatgcccaatatcaaactgaaattattaattggccaatatgcccaaaaatattatctaggaaatcggcgccaaagaaacttaactgaaacagttcgccacttcgaagactatttgccggactattttcctttggtccatccctcaccattgaactatggttggatgaagcagcatccctggtttttgacggacgtcgtgccgaacttgcagggacgaattcgcaagatcatgcaagatgattagcaatttcccttatagaaatattaatattgtgatattaatacctgataatttatggtaaactatttttgtgctattattcacatattttatatttcgggggaaacatcatgttaaagcttaagaaagcaactttgacagttgttgcagcattcacgatgggcggcggattaatgtcaattccgccccaagaagtttcggccagaaccacctatgtctggatcgcgtcaaaccacggcaaacgatatcactactcaaagacttgccgaggcctgagtaacgccggttacaagcgccacgtgaccaagcattgggcccgcagccatggttatcggttgtgtggttgggaaagataatcttctgcaaaaatagaaacgctggttcagtgtggattttaatccagattgagccagcgtttctattttttagttgccaatttttacgatcggtttgatgacactgccgtcggctgagtcttcaaaggcttgattgatatcggcaaacttataatattttaccagtctgtcaaatgggaataagccctttttgtagtagttgaccagtttgggaataaataattgtgggatggcgtcgccttcgatgataccaataatttgttttgcctcaccgatcacttctccttgaatattgaaagtcacatcgcctgccaaaccaattaacgcacaagtaccagatggttttaagacgtgaacagcttgtttgataactggagaaacaccagtggtatcaatactatactccactccagtttgcaataattccttaactacatcctctggattccgcttctgactattgatggtttcggttgcgccaagttcttttgcaagctccaatcgattatcatggatatctatcgcaataatatgatccattccaatcattttagcagccatcattgcagccaacccaacagcgccagtcccaaaaatagcaatagaactaccaaatttaggtttcaaggcattcaaaaccgttccagctccagtttgaaatccacatcccaatggaccaagcaaactaatatcgacatcgcttggcactttagtaacaccatgttcatcaacaaccgaataagtggaaaatgatgattgtccaaaaaatgtggaaatatctttaccaccttcactatgaatacgatgagtaccgtcaaaattacgaccaccagcattgagttcgttaaagtgaatgcaactggctggatgcccagtcaaacaattttcacaatgaccacaatacgaaaacgataagaccacgtgatcacctggcttgacagtactgacaccgctaccgacttctttgacaattcctgcaccttcatgaccaagcgcaaccgggtacggtgtcgtggcatagtctctaccagcagcatcagtgtggcaaatgcctgttgcttttatctccactaaaacttcatttgctttaggcgagtccaactctgcagattcaattgttaaatttgcaccctgtttctgggcaaccgctgttgtaattttcataaggtaacctccctgtactatcgatactgtgtctttgttcttagcaacaatatattcaatgtaagagcttacaaaaggattctaacatgattatttgaatcggggtcaatttaagcccacaagataaatgttctgacatcccaaaaaagcttttattgagcaacgatagtgacaccgtgtcatcgacgcgctataattcagatgttggttatgtgacacgacgtcactcacgaagtaaaacattcatgtggaggatcggaaatatgggggacaggaaagcagcagtcgggtttgccatgattgccttcttaagtccagcagacggttggttcttagctacctcaacgttggctggctttggattcggcatgctgatgggcgcccagctttccgttttgatggcccaattcgccgaccaagccgataacgggattgcgcttgggactttgtctgtcagtcgtcaagttggcctcacgattgcgccaaccgtttatgcgaccatcatccaaagcggatttagtcgtctgtcgctgagtacacctcttgaggaatactatcggaatttattagcaaaggcagccgaatcgcactccgacaaattagccaccttttaccaaattgcccagcaagcttaccaacatttgtttgtcgtggtcgtcgttatttcactgatcatcttggcaggtggctggatcctcattcgacggcgaggttcaaagaatatcgcctaatcagtaatgctaagaatttctattcgcataaaattgaaatccagcattcaagcctttatggccaaaataagaagccccagttcgattcagacacacgtccgcattgaactgaggcttcttattttgttacaaacttttaaaataacttacttcgtaatcgttgcccgcgtataatctgggaacccagcgacatgatactcaaccccgttgagtttcgggttgctgctttgtacgacggtcctagacactttgtctgggaataattttaaatggggtaaaggatgacttggcggcttttgctggcggactgataatctgctgcatcccccgaactcccatctccaagaactcctgagtgacactggttaattgtggccgcacgatgccacaaagtttcgtaccatcaatgctcatcacagccaggtcagccggtatttttaatccataatcccgcgcctgattcatcacgccgattgcggccaagtcactggacgcgatcaccgcggtcacttccggcttacggccatattgtttcatggcattaacgccatcttcataggcaaagtcaccgcccaaaacccaacctgaattcaatggtaacccattgtctgccaaggcatgacgataaccatccaacctcaactgaccggtcacagagtctaaatctgcagcggcaaatccaatcttggaatgacccttatcaatcaaatacttagtggcttgatagccgatctgaaaatcgtcggaggtaatgaacggcaatccccgattttcgatggtgattgacaggaacagaaacggaatattagcattcagtaacaagtcctcgttagccggattaaggttaacggcgaccagcaaaatccccattaccgaccgctcgatcacggtttccaatgctttccgctccatctgggaatcattttcgccggcaaatacgataatcacattcaaatcatgccgacgggcctcttgctgaataccattgataatctgatcagaaaagtttgatttggttgagctgagaatgactgcgatcaccttgctgcgacgggtaaccagttcaacggcagccgtatttttttgatagccaagctttttggctgttttttttaccttttttgctgtcttttctgagtaaaatgctgtctggccagacaacacccttgaaacagtggcagtagagacacctgcctgtttggcaatatctttaattgtgactgccatgattgcgccacctctctattatgtacgttgtaaagctatgtacgttgtaaagctttaatgggatcattaacgttaagcattttacattgttcaccccattttagcacagtaaacgtcgctttaatttttagtaaaacgcaatcgtttgtgttgttgatataaagggtttgcaaacgttttctttgggtgctattataatcgctgtaaacgttttcttgcaatatatatctattggccaagttgcgaaagcgttcacggagatagcttatccaagcagagatctacatataagtgttttcgacaaaaaattccagaactgagctttctgccaaagagacttacactccgatccctaaccgcctggatccgctcactttttaggaggaattactatggacgcaaaagtaaaagctggaaatggtgacgttaaaactgaacctaaaagttttgcatcccatttgccaagtttgaaagtaagtacgatttttgcaatgacatttggttttttcggggttaacatggcattctcgcttcaacaatcacaaatggggcgaatttttcaaactattggcgctaacccgaataacttaggatttttctttatcttgccaccgttagccggaatggttattcaacctttaatcggtaaatactctgaccgcacttggacccgttttggaagacgcatgccgtatttatttattggcgcacccgtcgcagcaattgttttggtattacttcctaacgccggttcattcggattcggttacggttcggcggccgcactgtggtttgccgctattgccacactatttatggacctttcatctaacgtttgtatgcagcccttcaagatgatcatcggtgacatggtcaacgaggaccaaaaagatatggcttggtcttggcagcagtccttctccaaccttggtggagttcttgccagcctggttccattcttccttgcattcattggcctttcaaacgtcgctcaaaaaggtgaagtgccaattaccgttaaattagcctactacctggccgcagccgttctgttgctgacctcgttttacacgattgccaaagttcacgaatacaatcctgaagaatatgctttatatcacaatattgacttaaccaagcaaaagaagcagcctagtctctgggaattaactaaaaaagccccccgagtcttctgggaaatctcaattgtccaattttttacatggtttgccattctctattcttggacctacgccgccggtgccatttccctcaatgtttggcacacatccaacccttcatcagccggttatcaagccgctggtaattggtatggcgtccttacctgcatccaggccgttgcttcggttatctttggtttgctggttcaagcacggacaaagccagaacatcgaaaagcatggtatgtctttggcctacttgctggtgcccttggcttcatcatgatcttcttcatccacatcaagtggctgctcgttttgccattctgtctgattgggatcacttatatcaccatgaacacccaaccattctcactcttaacagaggctttgaacggtgaaaatgaaggagcttacctgggactcttcaattgttcaatctgcttaccgcaaattgcagcatctctttgcagcttcttcatcttcccaatggttgggcactcaatgccagcaatgttcttggttggcggggtttcattagtaatcgctgcattttcagttggctttatccactcaaaactgagtaaaccggttaaactataatcacgagaaagaggagaattcaatatgaccaaaaaatggtggcaaaatgccgtaatttaccagatttatccacaaagttttcaagacagcaacaatgatgggattggtgatcttcatgggatcatcaaacgcctgccctatttaaagaagcttggcgttgacgtcctttggttgaacccaatttatcaatcacctctcaaagataacggctacgacattgccgattacgaaaaaatcttaccggaatatggcacgatggctgatttcgatgaattgttgaaagaagttcatgcccacggattgaagttactgatggacctcgtggttaaccatacttccgatcaacaccgctggttccaagaaagcaaacaatccaaggataaccagtacgctgactactatatgtggcacgatccagttaacggtcatgaaccaaacaactggcacgcagcctttggtggcagtgcttggacatacgttccagaacgaggtcagtactacctgcacttgtttgcccctggccaacctgatttgaattgggaaaacccagccgttcgggaatccgtttgggacatcatgcgattctggttggataaaggaattgatggcttcagaatggacgtcatcaacctgatttccaaacctgaaggcctgccggacgcacctgagccaggcacctacccgctcacagaaggtctggttgccgatggtcctaagttaaacgactatctccacgaaatgaacgaaaaggtactttcccactacgatgtcatgacggttggtgaaatgccgagttcaaagcccgaagatgccatcaactacactggcctcgatagccatgaactgaacatggtctttcaattccaacacgttgccttggaacccaatccagacaaacgcttgggcaaatggaacgatcagccggtcaagctaccagagttgaagaatgccctatcccgttggcaaaaagccttagatggaaagggttggaatagtctctactggaacaaccatgatcaaccgcgggcagtttcgcgcttcgccaacgatgatccaaagtaccgggttcgcgccgccaaaatgctgggcacgacccttcacatgatgcaaggaacgccatttgtctttgaaggtgaagaactcggtatggccaatgtgcactacaccagcatcgatcagtacgaagatctcgaatcaatcaatgcctatcacgagttggttgaagaaaagaagctagtcgatgggccaaccatgctgaaatatttagctaacatttctagagataatgctcgtacaccaatgccgtgggacgatggcaaaaatgccggcttctcagatgcaaaaccatggtttgctttgaacccaacctataaagaaatcaatgctaaagctgtggtggacgataaagattccgtcttttaccactatcaaaagctgattcagctccgtcatgattctgacttggttaagttcggaagctatgatgagattgatcctgatgacgcagaggtctttgcttaccggcgtcactatcaaggcaagacgttgctagtaatcagtaacttcactgccgacacggtgacgcgagattatggtcagggtaaagccgacaaactcgtcatcagcaattacagtgatgatcaaggtacggaattacgtccttatgaaagtaaggtctatgtatttaactagaatcaccatatattcggcatagagagccttctggtagtggttctctgaccggaattacgcatgaatttaaaatatatttgatcaatagaaccccttgaactggaaaaatccaattcaaagggttctgttcagaaatgttggctcaatgcagattgtgtctgaatcgagctagcactcctacttttaaaatcgattatcaatttttcagcaacttacttcgtaatcgttgcccgcgtataatctgggaacccagcgacatgatactcaacgccactgagtttcgggttgaccaaatggctttctctcacgtaatacagcggaatgatgccgttttggttcatcaatcgcttctcagcttgtctgagatatttccagtaatcggtctgattagcggcggttttggctttttcaatcagtgaatcatacgtggcatcgctaaacttgcccggattcattgtattgttggaggtcaagattcccaagtaattgattggatcgccgaagtcggctaaccagtaccactgagcaagatcaaacttgccttcgcttcggcgggcctgttgagctttgtcaggaaggttggcgatactaaccttgacgccggggagtttagaatctaactgtccctgaatatattgagcaacattcttggttacatcttgatcatcaccaacaatagaaagcttcaaatcaccagtaatcccggcttccttcttaccggctgccagcaaacttctggcttgcttgatgttaggcgcgacactaaaactagtctcttgactgaaatccttaccagtcgttgggtcaacggctgttcctgggctgacaaaactgctggctggcagtgacccatccgccaagaccttattggtcagttcttttcggttgatcgctaatgaaatggcttgccgcaacttttgattggcaagtggtcgccctttccgttggttaacctgcagataataagtccaggccttaggtatccgcttcaagtccttattcttctgcagggacttggcggtaacaccggaaatggtggcatcgtccaacttgccgtcctcgaataaattatgggccgtattggaatccttaacggtcttatagttgatttggtctaacttaatcgccgacctgtcccagtaatatgggttctttaccaaccggtaagcatcgttggtaccggtccagttggtaatcttgaaggcgccgttggaaacggtattcttagcgttagtcccgtactttttgacacccaccttttggacaaatgatttatcctgcggcatgaagaccggcattgcgactaacttgttgaaataggccatcgggtgatccaaattgatctcaagggtcttgtcgccggttgccttaattccaagcgttttgtaggaattcttgtgattgataatcgcatcggcattcttgattccactaaagacgtaggtgtaaaccgggttgttcgccgggttcaaggatcgtttccaggaatattcaaaatcttccgcttttacaggatcaccgttactccacttggcattcgaacggatatgaaagacatactttttaccgttatcagttggcttaacaatcttggtggccattgctgggactggttgatccttgctgttaagccggtagagcccctcagaaatgttggttagggtgttaaactccggcagcatggcttgattggtattgtccaacgacgttaaatcagatgtctgcattaaggtaatcgacttgttctgcgcattattttgggaagactgcttgccacaagccgccaaaaataccgcaaccatgacaattccaatacttaacgacacctttcggatctttcccatagtacccctcctagatgaattgcaactcaatcggaaccgcgtgctttaacgtttcatgaaccgtacagtccttgacgactgaatgcataaacgccttgtgcccagcctcatccaaattcgtttcggcatgaatctgaacaacaattttggtcaccgccgatcgcccatcttgatactgagtggtctcgccagtcgtcttggtttcaaacttcttaatttgaatttccgagtgctttcgggcgatgtcgttggctgtaatggctaaacaactgccgacggccgacaacaagtattgcaccggattaggaccagcgtctgttccgtgaccggcaatcggttcatcgacgataaattgatgaatacctgtttttgtgtcgacttgagcgccaacttttctaagctttgaattgataatatatttccccatgatgaacctcctcatgaatgtgtctcgtgcagattattaattattatagctggtttgtcactggatttgttggaagttgtttaataattagagcaaaatgcctctccgtcaatcctgacggggaggcactttgagttcacgtattaaatattaattaatcaaaacttcagttaccagcaatgcaccaccgaacacgaggacgaagacaaccaccggccacacgaaacgcagccagtgtgaatacttcatgttcagcatttgcaaggttgccatcaccaacccggttggggccaggaacagcattgcatactgaccgaactgataggcagttaccacgacataacgtggaatgtgaaccgtatcggccaacggtgccaaaatcggcatcgacagcaccgccaagcctgatgaagatgggacgatgaatcctaacaggaagaagatgatcagcatcacaacaataaacattggaccgttcatatgggcaaccaaggttgatgaatactggagcatggtgtcagaaatcttcccgttattcagcacaagattaattccccgtgccaagccaatgatcagcgaaacgccaaccaagctggaagcacctttcacgaaagcatcaacgacacccgtttctccaagcccatttttaccagttgccgttaggaacatgatgataattgcaaatgacaggaatgaagccgccatggttgggaaccaccaaccttgagacataacgccccaaaccatcagtgggaaggtgacaacgaataatatcaaaatcagctttttacgcattgtaaatttggatttggcatcttccccggttggggcaatttcccacattgcattaaattcgtcacggtcgtcataggagtaagaaaactttggatcagctttaactttcttgctgtaccagtgcagataagtcacgacaaaactggcagcaatcaccaaaccaatggcccgctccggcagaccttgggtaaagtcgatgccggcagcgttagacgcaatcaccacggaaaacgggttgatggttgaaaaacaggttccaatcgaactcgcgaggaagattgcgccaacagacacgatcgaatcgtaccccatagcaatgaaaatcggtaccagaattggataaaaggcgaccgcttcttcttcgatcccacaaagggttccacccagaaccatcaggatggcaacgaagaagatcagcaagaactcatgccctttggtcttcttggtcagggccagcagaccggattcaaaagcgccactggctttgacgactccgatcaagcctcccagaaccaggatgaagaccataatatcgacggcttcaatggtccctttgaccatgctggtcgggacagccgcaatgcttgccggccgctgtttgagtcgctggtaagtatttggaattgataccggcgcagtgatgccgccatctgtaaattgcttaatgttaattttgacgcccagcttgtctaattctttttgggtgctgggaaccgtggtgactttaccgtgtgggtcagttacctgcaaagatgaattcgtgtacgataattttgaataactaccggcaggaaccatccaggtggcagccacggcaacgattgtcaaaatgaacagaatgacaaaggcaccgggcattttcagcttgaaatgcttctttggtttttcgacttgtgcgtccataattttcccccttctgagaagtacaacacaaaatagatcagatttttcactggtcctgcctagtaatatgattattaatcaataatcccccaccacgaaaattattggattaatcgaatatagctcaacaaataatagtgtaacgaatatgaaagcgtttgacaacacagcatgtttgcacaaatttttcaaattaaattttactgagtattaaaaaagttcccgatttgtggttaattaaaattaggttgaattgtgtttcttatttacttaattataaatgacaagaacactaatcctcatctgaacagagaacagtgtccttttcaattctatgctgtattcagcagatatcacttcaagattcaatacatgcaagccactattaataattagtctggcgatatgcttgaatcaatggagaaattaacaacaaacctattgcattgattatccctccggtaacattgtccgtaatatttctataggctacagtatgtgttaacaataaactgtcggcaacaaaatatcctaataccattataatgacccccgttaccacagcaatataaagggttccaccttcatcatttgagtttgaggcaattttaccaacgaatattccctcaacactatgaataatcatggaaggaatcataaaactcagattcccatgaaaaaacacaatcaaaagcccgctgattccaccaacaacccctcctccccatgagccatatatgaaagctcccagaaagattccaaaatcacaaaaagttacattaattgaagtatcagggacagttaagacaaatgatgtactgacagccgcattaattaagacaagaagacacaatttagctctcaagggtacaagcaggcgagatggaacatgatctaatttcatctacttatctcttcaggacaaattcacgtaaatgaaagcttaagcgatgagctggtagacccggacgaacatatttgcttggttggcgaatccataacaggtccgtttgagttctttgatcttacggttgacgccttcaatagggccgttggagtatggcgacttagcggcgttgatgatccatgggagattcttgcgcaaggtggcgatggcagtgtccatgaccgaacctgttggctgatattcggtgattaatctcttgaggacacgaggatgaccatccatcaaggcttcgtggacggcaaggtaagtctcataggcagttttgaatattggcgataccgcagtaccaagatcgatggcattctgttggggcgagtattcattgaggccgaacaaatagcgagacttcttggcgtcgggatgagccaaatggaatagccgccaaagcgacttcaacaccttgtattcgcgagacttcccatctaattgtttgagcgttgtgacgcgaatctgatccattgcgcgtccgatcatttgcacgatgtggaagcggtcgatgataatctcagcgttggggaaaagctcgtgaacgatgagctgataggcggcattcatgtccatgaccacacgcttaacagccgcgcgttgcgcgacattatattgattgatgaagaactccttgatgtccttattgagccgtcccccaagtactttgacggccttgtgggtatcggcgtctatacaaatgaaagacatcgccgacttagtcgaacggaactcatcaaagcacagattctctgggagcttacgactggcgtgaggatggatattgtcgtcaagtgccctttgaacggagttcgtggagattcccagaagtagcgcaatggtttttactgtgagcgacttactggcaagttttaaggcgtctattgccagtttgtttccaattgaatggttcgctttgacaacgggtgtcgtcgccgtgcaagttgtatgacaattcaaacagcgccaccgttgtttgtttagttcaagaactacaggttgatctgacggaccctcaacgtggatgtgggtgagcttgtgtccgttcttgtgaagatcagggaaactgcactgtgggcagtgcgtgagcgtgtacgtgagttcggcgcggatcactaggtatttcttgcgaccagcccccttgccgtggaagtcttcgcgaacgtcttgaatattaatatttgtatctgtaattccaagcaatttgcgtgtactatctaattgagacatctattcctacctcgtttatcttttggtttggtcgcttaaagcataacactggagggagtaggtgttttttgttatctaaaaaggcctaaaacttccggcgttgacgaactcttcaacaccaaaaattttagacccgaaatcaccggggacttgacgccattggcaaccggttttcaagacatataggaccgcacagaagacctcgtagaggtcatattttcgaggcttagttcgcttacgaaaattttctaaagctggtcgaattaattcaaattgttgccgagtaatattgctgggataatttttcatagcttaaactcgctttttacatagaagtatatcaaaaatcatagatcttggacagcttcttaatgctcgggatctcccgggggtgctgttattttctttgggtgtccctgttattttgaggacggcgactaagcccagttccctccgcttaaaaaagatatggggtgcaatgcgcaaagaacgcgcattacaccccatatcttccttaatgctcaggaactcccgggggtgctgttattttctttggttgtccctgctattttgaggacggcgactgacccccagatccctccgcttaaaaaagtaatcgggtgcaatgcgcaaagtacgcgcattacacccgattacttccttaatgctcgggatctcccgggggtcagtcgcccactacatgcataaacgacttatccggaattctaattaaactaaatcgatcggcctgccggccagcatggagtccaattccattgaagaaattcttcttatacgtcgtcgtgaccgttgccacccacgcgtgctggtaacgcgtatcaaggtgatccaggtattccttattccacttgtaagtttctgcttggacattcagattactcttgccatacaccaccgtggcattcgtgctgttcaccaagtatttaccgccattgacataatacgtatagttttgaattggatttcgaccattgtcatttctaaccgtcacgtagtccgattgatcggagcgataacggatgatcagtggtttataggcataactggtggttgtccggttcgtgtccaattttttgacatcttggaaaaaggtcgtgtacgacatcccccacaaaaacagcaggaaaattgccacttcactacacgaaatccaaaagttacgccacgtaaagctctttttttcagtcacgatcaagcgaagccgacgcgcccgcatatcgtgaataatataagcaaagtaacagatgagaagcagccaaagggccatcccaactaaattccaggcggatttcataatcattcccctttttcttcttaattaatttaagtttacactagtttattggtgagtgcgagtatgagcaaagataagttgaataccattctattgcccagccagcgatgctttgtcataatttccattcaaaatcgtgttatatttaacttgtatgcgattccatcaaaactaatcaatgaggtgactaatcatgtgcaccagcttaaccctagaaacacttaatcaacatgtcctcctggcacggaccatggacttccccgtcaaagcggcttggaaaccggtcctgattaaccagccaaattatgtaaccgctttatcgggaacccgcccgatcaaatatccttacattggtggcggtcgcactgaagaaaatgacaacatcttggttgcagacggcgtcaacacccaaggcctgagctgtgccgagttgatgtttcccctgaaagcccattatttggacaatgaagtggatgacaagctcaatttgacccctcaggatttcttaccctgggtgctgggcgaacacgcttcactcgaagaagtcaaagcagacttgaagaacatcgccctgattggcaaatactggatggccggcaaagaggtcttttcatttcactggattctgactgacaaatcaggtcagacactgatcctggagccaacggttgacggcctggaagtcattgaggactcaatcggcgtcatgaccaactcgcccacttatccggaacatatggcccgactggaaaagaagctgaaagtgaccaatcaacagtccctggccgcaaaagcacaacaaatcatcatgagccaagacctgcccaaagcaaccaacaccccaaccaccagatttctggtagctgcagtgaacaaactcggcacccagcccagccggacccagtacgaagccagaaatcgcctgttcaacgttttagatgaagtggcaattccctacaagccgtcaatggacgaccatcccaatttcaactatacccattatatttctgtgttggattcaaccgaccagacttattactttaggtatcacgattccagacagctgttgtccttctcgttagctgacctggtcgaggaatatcccaacaccagccgcttcttagcttaagtagtcagcgatttttcgttggacaccctgctcattattggaataagccgttacctgctcaactttttgaagcaaatcggcagcagaattcttcatggcgtatccctcaccggcagcgttgaccatttcaaaatcattgccgttatctccgaatgctgcaacatcgtccaaggtcaatccccaactttgcaggagcatttcaattccggttagtttgtcggtaccgtcaaccatgacgtccaagccgttcatcccagaagaaatggcgtttaactggccgctgaatttgtgattgaattcatcctgccgcttgagcacgccgccttcttcccaagtgatgtcgagcttataaattgagtcgaagaccagccgcaaatcagccatcgactgcatattttcgtagaaatatttggaagcctggaagcgatcggaattctcgggtaggttgcagtacgtgccgtttcgaccgactaggatcacttcggcgccggcaaaactgggttcacttaaaatccaatccagggctttcttcaagactaaatggtcaatgatctcttcgtggatgatcacccctcgttcgtcgatgactaatgcaccgttgttacaaacgtatgagatcgggccgtggacatttttgaacagtcccaacagatgctggtattggttactgctggcggagatgaagtgcatccccttatcccccaattgatccaattgctgttggaactgttgctcatcaaaagttccctgatcattcaaaaatgttccgtccatgtcgcttgcaatcactttcaccacaatgactcctccattcaaatttcgataattggttatactctcattttaagggattagtttggtttgtaaattatttttatatcttgtatactgaatttgatcatacaactatctggggtgccttattggctgagaaaaacccatcgaacctgatctggacaattccagcgaagggagcatgctccgttgtatttagatggataaattgcaattagatgaatttctgaggccagggcaaaacgaccagttttgtgcctggcctctttgtgtgctcagcaattggactttcagtgacttatttgatcaaaatcatatttggaggtcttgttatggataacaagagtcaagcaaccggcggcaaaaagcaaagccaatggacgcttagaaacattattttaattgccttaattgctatttttactggtattattttttggggagccggctttttatacaccggattgactgttgccctgaccccatttggaatggccccatttgccaatgacctgttgatgggcctgtggtgcatggctggtccattaaccggattcattattcgcacgttcggttcagccttcttgggtgaattcctgggggcttcggttgaagtcttccttggcggtcaatggggcgcaggcgcctttatttccggcttggtccagggaattgcttctgaactcggtttcacactgaccggctacaaacgctatgactggttcggattgaatgcgtcaatcttcactacggttgttttgacatttgcctgggacatgattcgaaatggttatgacaaattcagtctgccactgctcttgggactattcgtcacccgttatatttcaacctttatcttcgccggtgtcttgaccaagatgattgttaaattattggatcgtagtaaagcaattaacttgtaattataggggatttgatcatgactgatgtttcaattaaccatttcacttttcactatccacaaagcgacgtcaaggtcttaaacgacattaatctgaccttcaagagtcatcatttctcactgctgtccggaccatccggcagcggcaagtccaccctgctgtactttattgccggcctatacccgcattttatcgggattgatgcagtcggtgagatcaaatttggcgacaccaacatcaaggatatcccccgggaaaaaatcagccagtcagtggcgatgatgttccaaaatcccaatcagcaattcgcgatggacactgtcgttcacgaaatgacgtttgtcttggagaacttgcggattgcgccggataaaatggataacatcatcaatgacgccctggaattctgtggcatcaagcggctgcgttcgcgggtgatcaacaccttgtccggtggtgaaaagcagcgagtggctttggcctgcatcgttgccatggatcctcaggtgatcgtgttggatgaaccgtttgccagcattgacccggggtcgagggaagatttgattaacaaattaaaattactccaacaagaacacggcaaaaccattattttagccgaccatgatttgaccagttatcggggcttggtggatgaattctactatttggatccggatacccatcaaatcagccttttggatgaccaacaagctgaacatttcttcaaaaacttcgaatccactcaacagatgcacaaacgagttgagattcccactggcgatgaccatgcgattatcaagctcagcgattttaaattggagctgcacgcctcactgctattgaccctgaaccactttgatttttataaagaaaaaaccactttgatcaccggcgccaatggcatcggcaaatccaccctgtttaacgcgttgaccaaactgctgccctataaagggaccatcgtctttgacggcaaggatatccaaaaaattcggccgttgccgtatgcgaagaaagtgacgctactgttccaagatgccgaaaaccaatttttgaacatcacggtcaaagaggagctcgatttgtcactcgccaatcgaacgaataccgactacacgcaagctgacgttgatgacatgctcagcaagcttgatatggcgggtaaagacgaccgcatcgtgtattcgttaagtgaaggtcagaagaagaagctgcaaatcattgaaatgttgatcatgaatccgccggtattgttaatggacgaaccattcaaaggcttggattatcattccctggaggtcgtggttggcttcttgaatcgggccaaaaacgatttccatcaaacccagattatcatttcgcatcagctgtccggattggataccctgattgattatcacgccgcctttgaagaccaaaatctgacttaccaggaggttatcaaatgaatcctggaatgaaattattattggtgatgatgattgcgttggaaatttcgtttacccaaagcttgattgtcaacatcatcctgatcaccatcagctttttatatattctcacccaacacgtcagtatgaaggccttgtttgggatcatcttttggccactatttcctgccgttggtctattcgtttctcaatggctgtacggaagtgccggcatccattttgcctggattctgtttacccggatctatgcctatgtattcctgggggcaaccttcacgttgaccagcagcatcaccgacctgtcgttgaccttggagcaggattttcatctgccctccaaatttgcctatggcgttttggccgcatttaacttaatgcctaaaattgccgaggaagttcgcattatcaagacttcggcattaatgcgcggcgaggcgctgcatttctggtcaccgaagctgtactttaaatcaattctctcgtcaatccaatggtcacagaacttggcagaagccatgacgtcccatgggtttgtcgaggattatgaacggacccactacaaggtcattcgcatcacggcaattgattgggcactgtttgttgtcctgctggccgccgttcaagttttgctattctttatcaaatactaaacgccaatattccaacatttccttttttgacttataattatgtaagagaaagatatattggaagaaggcgttttttatgcgggcaaatcaatttgcatttgcgtttggaatttttgcgttaatcgttggaattattgttgatatttatgggttggtcacccaatttggctcgctggacagcgcccaggtggtattgatcgggtcaatcattttggcaatcggcctggcattcttgtccctgccgaaccgctgggagcgatatgccggccagttggtcgttggccttggtttactgtactatttttacattcaaaccaacaaatggtgggtggcagtcatcatcgccattatcgccatggccctaatggaatatggactgaaacatcgttaaaatgtgtcaaaatttcaattattggtataatagatttatagagcaagttggatcacgaattttgatggaggagaatgacgatggcagaaaaatttagtaccttagcggaagaaattattaattatcaaaagaagaacgatatgcccgacacagcgttagcatttaacctgcacatatccgttgaacgcctccacaatatcaaatcaatggaatcggaccccacaccggacgagaagagaacgattgagcagtttgtcagatagagcgcgacgagcaacgggtgaggcggtttctaagggtattttgattgaagtccctgggtttgggactttaattaaagtgcacttagaagttagcctcagttgcgtcggagcgtattttgaaagccgaaggatcctcagaataacataagcgcaccagagcgcgacgagacccggttagggccctgaacataagtgtattttacaagaggaagagagacccaaaaatcccgacaaccgttcccccgagaaacaaaacaaaccacaaacgaaaaggaccgaagcagactcgcttcgatcctatttttgatgcttctcattcttctcggcccgataccggctcatcccttctttataaggattgccaaacaaccggctcaatcccgtccaccaggaattggtacttgccggttgattctcatcgactggcaacttcttgccacagttcggacagacaacgtcatccggcttcaacttcgccccacaatacggacaaaatgaaaatttttgctttgccatcttgcttacctcgattgctgttggcctttgttgcgattggcattgcgctgacgccgtttttcggcttcggcttgttccttggcagctccagcttggcgaatttgttcttcacgttgctttttagctttatcttcggcaataatttggttgtgcattacgttcatccggtgcgacagaaagttccagccgccgattaaaaacagcgcaccaaccactgagtacggaaatgtccaccatggaaagtaactaccatttttgaaaaccattgggccaagaaaattatagagtgccatcaatattgcgaccatcaaagtcacctgcagggtattgaccagccacttgggcatcttaaatccttttttctttgccaccatgcatcccccctaatcaatttcattttcagtcagaaaggccttgaaataatcaaaggccatctcgcgaatattctcgatgccaatttgtcgggttggcaaatcaccatcgtcatcgacgtctagcaattccacattcaaaactcccgtttgcagatcgattgaggttggatacccagcaaaattgtcctcatcggcagtctcaaaacgaatcactttttggtattgaatcgattgggtgatgatatgaatcaagatgttgtccgcgttatcaaatgcccgatcagaattcaaaaccggcaacgcaaaatgcttgttgtgtttattctcaatcacgaatttatcgatcacccgtaaataatccgagtccgtaataattctaccaatatcatcgtaacgaatccagacgtaaccgccaaatcggccgttcatatcgacaaccatcatgacaaattctttttcgttgctggaaataatcttgccaacgtaaaaatacttccggttatcattggtgtcaatcacgacccaatccccgctattacgcagttgttcaatctgatcacgaaagacacttggatcatcaatgatctcattttccacatgattttccggtttaatcatatccaaaacattttgcagcagctgtagttcagtcccaccaaactcaataccacgaatatcatcaaatcgaatgttgaacaccgactgctttgagaaatcaaacttattaatgttagtaaagaccattccgtcgtcttgaaggtccgaaatgagcccttcgttatatttcagcttgcctgcctgtgcggtaatcaccagaccgactttttgatcatcgtgcaatgtctgaatgacccggtcgaacaacgagtcgctcatcttgattggtaaatcaaaagagggctgggaattgaggtggtgcttctcgtcaaactcaattcgatcctgcatgtttgccaagtcgtaactgtcggtatcaatggatttaactgaagaaatcttcaaataaacttcaccatcctgaatgccgtaatcgttgtaggtcaacatgatgaaatctttatcgcttaaaaactgaatgacaccggtgtaaacgatatcggagtcattttgaaaagcgttaatcagctgctcgtcgatttgggcggtgcgcagcttgtcgtagagggttttcatggtgtcacttctttcttggttgggttggttgtttgtggtgctgatttgtggtgcttgcttgtggtcgattaaggttcaagctttaattttctctagtggaaatgtgctccgacgaccctggtccctactgcgtaagtcaaaaatttcaacgatgaacaaagaccgttcatcattaaaatttttgacttacactccgggaccacccaggtctcgtcgcgcactctacgaaattgcattccccataaattccctaagttcatcacccgacatattatcactcaatccaactaaaagcttgattcttgctttctggccgttcaatccttggcagagaatcgttcccatcttcattaattggatgccgccgccctcataatcatagatatcctgggcgacgccgttataacatcttgagaccaagacaattgggatatggttatccaataatcgttggatcgccggtaaagtttggggtgggacatttcccgctcccaatccttccagcaccaatcccttggtgttgtcgttgttgatggcgtcaaacaacgtgccgtccattcccgcatacgccttaatcagatagacgccttcgaccacctggttgatgtcacacacttcggtttgaattaattcctggaagtattttgccttgttttgcgttacaatgccaattggtccaaaagtcggcgttctaaacgtcgccacattggtcgtatgcgtcttggtcacgtatctggccgtgtgaatctcatcgttcatcaccaccacgacccctttgccgtaggattcatcggttgcggcgaccaggatggcatttctaaaattgtacaacccatccgagccaatttcattagatgatcgcatggcacctgttacgacaaccggaattgtgttgggcagcgtcagatccaagaagtaggcggtttcttccaacgtatcagtaccgtgggtaatcaccacgccgtcgacaccgtcatcaatcgccttcataatacgctgcttaatttttaacatcacctcaggagttacgtgaggggatggcaggttaaacatttcatcagtaattaagttaatctgaccctttaagatcacttgttcttcagcaatcgggttctcatcattggggacaacttcgcccttttcgttttgagacatcgaaattgtgccgccagtatgaatcgcaagaattgttttcatcaatttcatcctccatcaacctgttaatctataccattgtaccgtaaaatggaacatgaataactatcaatcaagaaagaagtctcagatatgccaaattccgaccgctactacacgccgcaaaattcgaaagatgcgatgcgccagatcgaaaaactatttaacaagtataaggacgccccactcacccaagaactcgtcgactaccatcagaatttggtgaaccgcttaaagactgacattctggcggctgccaagcaggaaaacgttcccgcccgaattgagtcaatcaacacgatgatcgccgccatggagcgttggttaaaggtccgcttggccggcaatccctataacggcaagatgaagaactttaaatttgtcagtgatgaatcactgcctaagttcaagcgccacgtccacaagatgaatggcggatcgacccaccgttcttcaagacattagcagtttctctttgtaatcacgactattacattgcagaaacgtgggaattgaagcagtttccggccatataagcaaaaaagccaaatatcccggcccgggatatccgactttcttgcttatattctggaaactaaccgcttcatttcccactctcaatcgttataattaatttatcaatcatattagggggaagaccgttgagcaaaaccattgttgaattaaagaacgtctacaaaaagtacgacgacggctttacagctctcaaaaatattagtttcaaattacaggaaggcgaattctacacccttcttggcccctccggctgtgggaagacaaccatcctccaatcaatcgccggctttacagaagtcacatccgggcaagtgctgtttgacggcaaagaaattaacgatattcctgccaacaaacgccagctcaataccgtttttcaagactacgccctatttccaaacatgaatgtatttgacaacgttgctttcggcctagtcgttcataacgccaaaaaagacgaaattcaaacccgggtgcacgacgcgctcaaaatggttcagcttgaacagtacgccactcgggaaatcagcgaactatcaggcggccagcaacagcgaattgcgattgccagagcgattgttaatcgaccaaaggtattgttactcgacgagccgttatcggccttagacgccaaattacgcaaggatatgcagtatgaattgcgtgagcttcagcaaaatcttggcattacctttttatttgtcactcacgaccaggaagaagccctggcaatgagcgatgaaatctttgtcatgaacaagggcgcaatcctccagaaaggttcaccggtcgatatttacgacgagccaatcaaccactttgtcgctgactttatcggcgaaagcaatatcattcccggtaaaatggtggccgattaccaagtcgcctttttagggcatcaatttgaatgtgccgacgctggcatgcggcccaacgaaccggtggaagtcgtgatccgtccggaagacctggtcatcactacgccggaaaaaggcaagttgcaggtcaaggtcgacactcagttattccgtggtgactactacgaaattcttgcctatgatgaggccggcaacgaatggctgatccattccaccaatgccagcacggatgatgcgattatcggcttggcgtttggcccagatgatatgcatatcatgcgttataacgaaactgaagccaagttcaatcaccggcttgaaagttatgaagagtaggggggggcggaacatgaagcgaaattatcgggggctttttttcacgccttatattttgtggctggcaatgtttgtcatcgcgccagttgccctaatcatctattattccttttttaatattcacaatcatttcactttcgcgaactaccaggagttcttctcgtcaggaacgtatttgacgatgacggccaattcggttctctatgcctttttgattaccctgttcgcaatcttgatcagttatccaatggcgctggtgatcagcaaattaaagcaccgcgacttgtggattctgttggtgattttgccaacgtggattaacctattactgaaggcctatgcatttattggcctcctcagccacgatggcttagtgaatgatttgttccaattctttggcatccctgcccagcacatgctgttcactgacgccagcttcattctggtcgccgcctatattcaaattccgtttatgatcctgccaatctataactcgttgaccgatatcagcgattcctacatccgcgccagccgcgatttgggcgccaccaaatggcagacactgaccaaagttatcattcctatgaccatgccgggaattaagtccggtatccaaattgttttcattccatcgctgtcactcttcatgctgtcccgattaatcggtggtaacaaggtcatcaccttaggaacggcggttgaggaacacttcttgacgacgatgaactggggaatgggttccacgatcggcgtggtcctcattatctcgatggtcatcgtgatgctgttgaccaacaccaagcgtaaaaggaggcggacatcgtgaacgataaggcttccagaaccggtaaaatttatatcaccattgtctttttgctattgtatattccaatcgtctatttaattctgtactcattcagtaagggcactaccatgaccaatttccagggcttttcgctgaaacactatggtgaattgtttaacgataaacggatgctggcaatcttcttgaacacgatcctgattgctctgctgtcttcggtctgctcgacgattatcggcaccatgggggcactggccgtccataatgccaaacggcgccacgaaagagaaaccctcctatcactaaacagtatcctgttggtatcaccagatgttatcattggtgccagcttcttgatcttctttaccgccctcaagctgccgctgggattctggtcagtgctgctaagccacattgcctttgaaattccaattgtcctactgctggttttgccaaggttggacgaaatgagcccgtcgatgaccaatgccgcgatggatcttggcgccagcccgggccaaattttaagtaaaatcgtcctgccttacattcaaccggggattattgccggcttcttcatgacaatcacctattcgttggatgacttcgcggtcaccttcttcgtaacgggaaatggcttcaccaccctgtctgtggaaatctattcaagagcccgccaaggtatcagtttggaaatcaacgcgttggctggtatcatgttcatcttctcgctcatcttagttggcgtgtactattggattgagaccagaaacactgcctcgactggtaagaaaccaattgtggaggtgactgaccgatgaaaaaatttctcgcagcattgattgccattctggcgttgtgcgccggcttggcttatggcagtaatcagctcaccaaatcaaccggggataccggcaataaggtccttaacctctacaattggggcgattacatcgatcccagccttttgaccaaatttcaaaaggaaaccggctaccacgtcaacgtcgaaaccttcgacagcaacgaagcgatgtacaccaaaatcaagcaaggtgggaccagctatgatctcaccgttccaagtgagtatatggttgaaaaaatgaaggccgatcacatgctgattccactggacaaatcacgtctggttggcatgaatcattatggccgctcatttctcaacaaatcctttgacccgcagaacaaatactccatcccctacttttggggaacactggggattatttataacgatcaatatgtcaaaccgggatccttggagcattggaaccagctttggagtaagaaataccggaatgatattatgttgattgattcagcgcgggatattctgggtttttccctcatctcgatgggtcaatcagtcaacacaaccaattcagctgaactgatcaaggccaaggacaaactcaatcgtttgtcacccaacgtcaaagcagtggtggccgatgaaattaaaatgtatatggcagaaggtgaggcaccggtggccgttgactggtccggtgaagcatcggaaatgatgtcccagaattcgcatctgcactacgtcgtccccaccgaagggagtaacatgtggttcgacaatttggtgattccaaagacggctaaacatttcaaggcaatttacgccttcctgaactttatgaacaaaccggaaaatgccgcccaaaacgccgagtatatcggttattcaacaccaaacatgtcggcttttaaactgctgccaaaggccacccgcgacgataaacagttctacccaacccaaaatgtgattgaccgactgcaggtctacagtaacttgagtccgcagaaagtccaagaatataacgatttgtatttggaattcaagatgcaccattaacccggattaaattcttaattggtctttgaccgccaaatgcattaaactgataacgaggtgaaaataataatggcaaagaaaaacatgcgacaagaaatcatcattgatatggacgaatttatcgtcacatacgcagcaaccctcttggatccgaaccagaacctttccgagttggtgtataacacagcaaaagaagatattacaaagtgggacgacttattccacgaccaaggatttggccgcaaaaataaatttatcaacatcggccgaggctacttaagagatgcccaaaacttggacgctgaagaggcggaaaagcaaggcgaccagttagcccaagaagccatcgattacttgggaaagcacacggactttttcgagaagtggagaacagactagagcgcgacagagcgcgacgagacccggttagggcccagaacataagcgaagaataccaatgatgaacggtctttgttcatcgttggtattctttgtttatgtggccgggccctgggtcgtcggagcgtatttcaaaggccgaagggacttcgaaagaacataacaaacgcgacagagcgcgacaagacccgggttgaccccaccaagtaggctaggccgttttcatccggccgtcggaacattagcgaaaacatccaatgatgaacggtctttgttcatcgttggatgtttttgtttatgtggccgggccctgggtcgtcggagcgtattttaaaagccgaagggagcgcaaaagaacataacaaacgcgacagagcgcgacaagacccggttagggcccaccaagtaggctaggccgttttcatccggccgtcggaacattagcgaaaacatccaatgatgaacggtttatgttcatcgttggatgcttttgtttatgtggccggggtcagggtcgccggaacgtattttaaaagccgaagggagcgcaaaatgacctaacaaacgggccccacgttcccaaacataaagagtaagaaacccattgcaccccaaaagaacgcccacaagctttttccaccaaaacttcccaactttgcgtcataatagacctaatcaaaatatgagaattctggggggaagggctcaaaatgaatcacacacctgcacaatcaacgacacaaaaaaatggttggtggattttggtttccatcggcatgtttgcattcatgtcgaacctggattccagcatcgtcaacattgccatgcccatcatggccaaacagttgcatgtcccgatgaatcaaattgaatgggtggtttcgtcatacctgatcgtcttaactgcactcttgctatttttcggtaaactcggcgatatctatggcaaaatcaaagtctttcgaatcggaacagtcgtcttcttgcttgggtcatttctgtctggcctgcaaatcaattttccgttcctgctggtcggtcgctttattcagggaaccggagcagcgatgactttatccaacaattacggcatcaccacgtccacctttggtattaaggaacgtggccgggcaatgggctttgttggaaccttcgtggctttgggggcaatcgccgggcccggacttggtggcctgattctttcaaggttatcttggggctacattttctgggttaacctccccattggcattgttgccgtcattctgggcgccattgtcatgcccaaggcttatcaaacggtgccgggaaccatcgattggctaggtttcatcaatttctcactgatgattatcggcttgttcctcggtgtcttcatcggccaagaaattggctatgggtcgccaattgcactggcattatttgccttagggctcatcaccatgtggggctttttccacgccgaaaaacgggccaagaatccattgatgccgctgtctttgtttaaaatcaagccattcacctatggcctcggggccgctgttttgatctttctttccaatttcttcactgtaatcatcgtgccgttttacctggaagatgctcggcacttgtcagctggcgaagccggcgcattgctgatcattttcccggtcgtcatggtgtttgccggcccgtttggcggttggttggctgatcacttctcgccagccgcaactgccaccggtggtctgttgatcgtcgctgtcgcccaagccatgtatttcttcttaaccctaaccagcccaatgtgggtctacgtcgtcatcacgatcattatggcttttggcaccggcttgtttcagtcgcccaacagcgatatcgtcatgtcggtggtcccaaaggattcattgggaagtgccgggagtttgaacgccctggcacggaatgttggcatgatctctggtactgccttatcaaccagtgccctatttatcgccatgagtgtcaaagccggattccatgtcaccaactatttaccaaaccagccggaagtctttattttcggcatgcacgttgcctttgcggtttcactggtgattatccttggcgcttgggtgctgtcaatcatgcaaggccgaaccgtcaaacctggtgatttgaaataaccatttggtcagttgaaagatcccttgattttgccggtaacgatgcgttttgattatcgtcatcaatctttgtaaatagtccataaataaaaagtgagacctggcgttaagccggatctcacttttttgcttacttaattttagttgcttgtcccttacgcttccggtactcaattcttcccagcttgataatttcggtcacaaccagcacgataaaccctgcgatggttggcacaacccagccatagaagaagtcgatgctaccagtgtggaagacgtcttgcataaacggaatgtagaacatggcagcttgaagggccaacagaattccgatgatgataaacgccatcttgttctcgaagaaatgcttggaaataattggataggagttgcgaatattgaacagatagaaaatcttaccgaagataatgatgttgaccgccatggtactacccagaacagctgtcaggacacccgaatcaacaaatcgatcgaaggtgaagatcccaagggcggaaattaaaatcgacacgtaggtaatttcgaaaacgtccatttttcctaaaatccctttggcaacatttcttgggccacggatcatgatcgactcttcagccggttcaaagataaacgcaaattgaatggtcaatgccgaaaccgtgttaatccacagcagttgcgttgggaacaacggcaactcttgtcccataatcatactgatcaggacaaccaggccttcagcaaaactggttggcagcaggaatcggattgtcttttgaatattatcaaagacatgccggccttcagcaaccgcatcaacgatggttgtgaagctatcgttaaccagcaccatatcggcagcttccttggcaacggcagttcctttaatccccatcgcaattccaatgttggcctgcttcagagcggcggcatcgttgaccccgtcaccggtcatggcaacgattttgctgttggcctgttgggccttgacaattcgcagtttgttggctggtgtggttcgggcaaaaacattgtaacggccgatgttcttaattaaatcttcgtcggacatttcatcaatctccggcccggtgatggcatgaatactttcatccaagtccagtttgcgggcaatcgctgatgcggtatccgggtggtctccggtaatcatattaaccttgacgccggcacggcgaaggctttgaatcgaaggaatcacttcttcacgaggtgggtcaataatcccgacgaccccacttaattgaatgccgtccgcaatcttgtcctggtcaatctcgtccacatctgtggaaacatttttgtatcccagggcaaccactcgcaaaccttgctcagttaatttggcaacccgttcataccaagtctggtcatcaaagttggggtcactttgtttgaccatgtcgaaaatggttcccggtgcgcctttaaccattaactcgtgatgatcattttccttgatcaagcgggcactgtatcggtacgccgaatcaaatggcagcgtatccacttcatcgacttccggctcacggccgattaatttgtgaaataaggtcgttaacgcaccatcagtcggctcaccgtttaattgccattcgccatcggtttgcaccaactcggcatcggtggttgtcccggcaatgtcgaccaagtcgcggaattgctggtcttgtttccagtcatatttttgaccatccaataagacgtccccatcaacgcctttatcaccggcaataaatccaaccccggtaacttgataatgatgttgatcggtaatcacgtcggtaaccgtcatttcgttcttggtcaacgttccagtcttatcagtgtcaacaatatccacagcacctaaggtttcgacggcgggcagcgttttgacaatcgccccttttttggtcatcacctgaacgcctcgagccaaaacaacggatgtcgaagccggcagtccttcaggaattgagcccaccaccattgtgataatcgctatggtcaaggttggcagactgtaaatcttggtgtagagaccgaggacaaacagcaaaatggcaatcgccacaataaagagtgacaggttaatccctaatttgttcaaattccgcatcaacggtgtcacctgggtcttcacctcggcaacactttgttgaatctgaccaatttgggtatccttaccagttgcaatcacaattccgaccccggatccctgagtcaccgctgttgaagcaaacgccatgttggagcgttctgccaacggaaccgaatccttgttaatcggatcttcggtcttttcaacggagttactttcaccggtcaaagtcgattcttgagcccgcatattgtctgcggaaatcaggcgcaaatcagccggaaccgcgtccccagcctcaaggttaaccagatctcccacaaccagttcccgggccggcacttcaatcttgtggccgtcacgaatcacatagttctggctcaccaacagttccttgattttgcttaacgcattgtcagcctgcatttcttggaagaatccaataaacgcgttggcaataataacgatcccaataaccgccgagtctgaatagtgatgcatgaacagcgtaatcacagccgcagcgatcaaaatgtagatgatgctgttgttaaattgcagtaagaactgcagcagcttgcttttcttcttggcggttaattcattgtaaccatctcgagccaggcgtttagccgcctcttgctcgctaataccgtcctcttcgttggtctgatactgttttaccaactcatcggtacttctctgccacaacttttcatcgggaggaacctcgttcatattgtctgccattaaatgtatcacctttccttttacaaaaataagattgttgttaagagtattataatatattactcactacttttggtatataaaaatcttaaaaatcgaccacaactcatgtgatcgattccaaatccctatttgacaactttggtccactcgtcaatcgtcttgccgttttcatctttcaaaaccagccaactgttgatgccggcaaaatagaggaagaggcccacttcattgaccgattttaaaacgatgtctttggtggtcacaaaattccggaaactatcggcatgttcagatctcagtttctgagcaaacttggccgaaaaccccagcgacccatcctgattcaaatcgggttcgactttcatcaccgcgccggccttaatcaacatttcgttacgcttctgccagtagacggttgctttggcaccctcatgatcaacataaaacggaatctcactcacctgtttggtgaatttgtggcgtggcttgcccttgaatttcttcttggaaacaaatacggattggaatccaagaccattcaggacggttaaaaccaaatttcgaaaggcttcaacggtttttcgctgattgctgggaatcttgaccgtttccaacagatctttcttaagaattccccgttcaacggcatactcggaaaagctcttggccaaatagccagcctccaagtcccaggctggttcgatctgaatcacaccgtcggccttgtcagttggttcggtctgaacgctgatcagcttcccgtctttaaggtacaggttaacgtcggcattgacctgatcgactgtctttgtgaccacaattgtcccttggccgtccggtaaggtcatcctggtcgaatcatcattgatttcaactgccaatttcatgctgcattccccatttcatttgttcttctcgttaatcataccattgaataacaaaaaagaagcccacaaccctttagtggtaaaggatcatgagcttacttttaatcgaagaagaagtttgtgatgcatagattattctgtggtcagtttgttggttaaattaccggaccatttccagttttgaacctctggaatatcggtaccgtattgacgaatgtaatcgtggtgcttttggagcatgtggtccatcttagcttcaaaattgtctgccgaagcggcgaacttggtccgagaaatagcatccttagccaagtggtaacgatccaattcattgaggacccgcatatcaaatggggttgtgatatccccattttcacggtaaccatggaaactaatattgtgattatgacggttatataccaggccacggaaggtattctcaaagccatggaaggcaaagataaccggtgtgtcagtggtaaagtacttgtcaaattcagcttgggttaggccacggctatcctgatcttcgttgcttggacgcagtctcaaaatgtcaacgacgttgatgaagcgaaccttcaattgagggaaagcctcgtgcagcatatcaatggccgccaaactctccatggtggcttcggtaccggcagtcgcgaagatcacatccggatcgccttgatcatttgaagcccatggaataatccccaaaccatcgttaaccagcttagtggcttcatccattgagaaccattgtggccgtgggtgtttggaagccacaatcaaattggtcttctcgcgggtctgcaaggcagtgttcataacggccagcagtgagttggcatcagctggaacatattcgttaaccaactcatgacctttttcagccagatgtcccaacatgccgggatcttgatgagtataaccattgtgatcctgctggaaagcgtgggaaacgttcatgatgttcagtgacggataatcatgacgccacgattgttcagaggcctttctgagccacttgtagtgctgagtgagcattgaatcaatgacacgggtaaatgcttcatatgaggcaaagaatccgtgacggccgcttaagacgtatccttcaagccaaccttctgcttggtgttctgaaagttgtgaatcaatgacgcggccttcaggagccatgttttcgtcattcggggtcttgattggttcttcccattgacgcttaccataatccagcattgagaagaacttattggatttggtttcatctgggccaaaggctctaaatgacttgccgtttcgcttcataatctcggtgtagaagttggataatacttcagtatcctgagcttctttgtcacctggtttgtcaatcttcaaagcgtaatcggctgggttaggcatgtccaacttcttggggttaataccaccattgacgattgggttcatcgccatccgccggtcaccgtctggggtggttgctttgatttcagctttaattgagccgttgttgttaaacaacttttcaggttcatatgatttcagccaattaattaacagatctttgtggtccatctgaccagcactgacaggaattggcacttggtgcgcacggaatgatccggcaattggattgccatccaagtcgaacttaggacctgtccagccctttggtgaacgcagtaccagcattggccagtgtggcaaagtatcatcattattgtcacgggcgtgcttttgaatggccttgatttcagtaatgattgcatccatcgttttggccatcgtctggtgaacccgggtatagtcttcggggtcacctttcgtttcaacgaagtatggcttccagcccatgccttcaaagtacttggttaagtcagcgtcactcatccgggaaagaatggttggattggaaatcttgaatccgttcaggttcagcattggcaaaatggcaccgtcatgaattgggttgatgaatttgttggagaaccatgaggcggctaatgggccggtttcagcttccccatcacctatttcaactgcggcaatgacgtcggggttgtctaaaattgccccggtaccgtgggcaatggaataacccaactcgccgccttcatgcattgaacctggtgtttcgggggcagcatgggaagcaactccgcctgggaaggagaattgtttgaataatcgttgcagaccagtttcattttgagcgatctttggataaatttcgctatagctgccgtcaaggtatgaattggaaaccatcacctgaccaccatgaccggaaccttcaatatagaacatattcaaattatatttcttgattacccggttcaagtgggcatacataaagttctgtgaggcaattgtgccccagtgaccaatcggcttaatcttaacgtcgtcagcgactagatctcgtttgagtaacggattgtctctgagaaacagttggccgactgataaataattagcagccttccagtacagattgactttttgcaggtattcatcggaatcgaagttcgtcatattagtaacctcctgaatttaacagtaacgttattaccaattcgattattggaccggtccaaatcaaattacaagtttattgtatgcctcagaggttgataattcaatggtttaagcatttgaataatttattttgatatagacgaaatttatactaattccatttagtataaggattagcgcagatttcatgaaatatattcagacaatcaggattagaaacactttccacaaataaggctgggacactttttacaaatgtcccagccgatttaattaccctttgatccagataggtcctgtcagacctactgatcagcctgtttgcgactaatagtgacgctgtcgatgaatgtgcaagtacttggctaagaaatacgccaaatcacaataccaggtttcaatttgtttcatgattcgtcctccaatacaaacatgacccgttttaattcacccagtgcatcccctggattctgccattgaaaatcatatcccagggaaagatttcgataccgaatgccattttccgtgactgcgttgggcatgtgggaatggccactcaatgacaagctgacgtggttgtgttcaaacaactgtcgataccggtcgctgcctaactgatacatgaaccgatcataaaacggaatcggcagctggtgagccaactttttcgtcggcagcatgtggctggccaccaagatctttttgccgctgacagccaatcgattgatttgatgctgccaagcaagaatctgctcgactacccatttacgatctcgccgataactgatttgattgccattaatatatagctgatcgggccagacatgtttggcaacaaagttattcgcgtatcggggaccgtctgcttcacaaaaatgtttggcaaacgtgtaatcgtaccatccattaatcccggtgatcagccagtgcctggtctcgattggatgccgagttaaagacgttggcagcctgtccagttcacgataagccgttcgggaagccgactgaatctgctgaactgatttttgccgggggtgatccacgtagagatcgtggttgccaatcaaggtgtgaaacggaactggcaaggcttctgccaattgttgatagaaccgcaagttgcgttgaagtccattcgccgagtcccccatgatcaccagctggtcaagattttcatcactgatcaattggcccaatacggacacaaaatcatactggcggttaaaatcaatgtgtaaatctgacacaaaaccaatccgcatggttatctctccaatctggttgttttctatattgtagcgcacgaaaaacggaccaaatcaaaaaatgagaatctttaggagttcgtaagtataagaaagctgctgacaagcaattagtgacttgattggcatcaaacgacactttgataccagaaaataataaaagatccgcatcatcccaagcatcgggacggtgcggatcttttttaaggtaaaggattatcaaaaccttccagcttcgttctagccgagataaggattctccggaacccgtaccaaatcatcggcaaccagtcgttcagcaatctgaaccgcattccaggcagcacctttcaagaggttgtcggaaacgacccacatgttaaatgccccttcattttcaaagtcaggacgaacccggccgacaaatgtttcgcgcttgccttcagcttcgattgactgcggataaatttgatgggcggtatcatcttgtaagacaacgccatcggcaccatccaatgcagctttgatttgatcagcagtcgcattcttatcagcaacttcaaagtaaactgactcaccatgggcaattcggatcggaactcggacacaggttgcagtcaccttgatgtctttagcgtccatgtcgtccaacataatcttcttggtttcgtgaatcatcttccactcttcatgagtgtagtagccgtctgattcgaaaacatcaatctgtggcaataaattaaatgccatctgataatgcttcttgtcacccttggtaggcaaaatctttggatcagttggttcgccgttcaatacctgttgggattcttccattaactcattcagtgcagattggccggcaccggaaaccgcttgataagttgagacgataacttgcttcaaaccatactttttgtaaatcggttcaaggcaaaccaccatttgaatcgttgaacagttggggttggcaataatgccgcggtgattataaagagccttttcgttaacttcagggatgaccaacggaacctctttttccattcggaaagcactggtgttgtccacacagacagcaccacgcttaaccgcttccggcaggaattttttggatgttgagccgccggcagatgacaataccagatcaattccgttaaatgagtctggggtggtttcttcaaccgtgatatcttgaccacggaattgaagaaccttcccggcagaacgtgatgaggccaatagtttgacactcttcaccggaatggttgactgctctaattgttggatcatgcgggtaccgacagcacccgtagcacctaaaattgcaacgttaaactctttcatcctaatgaatccccttttctctattttgttaactcaagtaaataactgttcatgcgatccattgccaatgtgatgtcttcatcagacgccgcatatgacatgcgaatccagccttcgccgccggggccaaatgcggaaccgggggtcacgccgactttggcgtcctttgccaaatgagtggcaaattcaaccgaggtttcgtctattgtatcaggaatcttggcaaaaatgtaaaatgcgccttggggcatgacaatctgcatccccattttttcgagccgatcagcgatatagtcacgccgtttgtgataggcagcccgcattggaatcggatcatcaaggccgttggtcaatgcttcggcagctgcgtattgcgcaggattggaaggagcggtgaccacgaaagcgtgcattttggatgcgttggtcacaaaatcctttggtgcaacaatgtagccgattcgatatccagtcatagcatgggatttggacaaaccgttaatcaaaatggtttgaccgggaatcatggccgcgattgagtgatgcttgacgccataggtcaactcactatagatctcgtcagccagcacatacatcttgtgttgagaaataatatcagccaacgcctttaattgagcctctgtgtattcaactccagttgggttggatggataattcaaaataattgctttgacactgtccccattttcatcaaggactttttgcagcttttcaggagttaagacaaacccatcatcagaagtgtcaatggtgatcagttcagctccggcaacttgaataattgggaaatacaaggcaaatgccggggtcggcacgataaccttgtcacccgggttcaagatagtggtcaacgctgaatagatcgcttcggtagcgccaacggttaccacgatttcagtggccggatcatagtaaacacccgtccggtccttgagataattgctgataccgtcgcgaagttcaggaattcccttttgtgctgagtagtgggatttgttttcctcaatactcttaatagcggcctgtttggcatgttccggaacatcgaagtccggttcgccaatcgtcaatttgacggtgccgggaattgaagaaatctcctggtcaaattcacgaattcctgaaggtccaactgcatttacattttgattaacgacttctgaaagtttgctgtctaactgtggcatgttttcctcctgatttaattacataatattttctaagccgacgattaacttggtcgctttggcggccgccggcactgccagttcaaccccgctcatgaaagaggcgcggtcaaacgagtcttggcggatcgtcaaggcttcacctttgctgccgaaaagaacttgctcatgagcaacgtaaccgggcaggcgaacggaatggatcttaatcccgtcgtaatcgccgccacggacaccctttaaggcttcctcggttgcgggtgcatcgtgcttcccacgaacttcgtcaatcattttagcggtcgccagagcagtgcctgaaggagcgtccagcttatcgtcgtggtgcatctcaatgatttcaacgcccggcatgtatttggcggcttctttggcaaacttcattaaaagaaccgcggagatgccaaagttgggtgccaggattccaccgacgttggtttgttgagccaactttttgagctgatcaacttgctcatcgctcatcccggaagtcccaataaccggatggatgccgtgttcaatggcaaatttggcattgtcaaatgcagccgcaggaacggtgaagtcaatccaaacatcggcgtcggtgtcgatttcatccaaactggcaaacagcttaacgttatcatccattcccatacctttgagatgaacggtgtcgattccgggattgtaagccccaaccaattcaaagtcatcgtttttattgaccatttgaaccgtcttttgacccattgagcccatgaaaccagcgactaaaactttaatcattgaaaaaactcccttgtctatctttgtttgataatttccaaaccaatcggcttaactgcgtgccatttcagtgccgtcaactggaatatcttccaggcggctgacacctaatttacttgccagggttgctttttcttcatcgttcaatgaaagaattggcaagcggcaatcaccggccccaaagccttgaacattcaaaatggctttgacacatgacggtgatgggtacatgaataaggcttgcacttttggcgtcaagaaacgcatcatgtcgccggcagtctcaacatcgcctgattcaagggcgtcgtacatcttccgcatctcccggccgtaaatatggctggtaactgaaatgacaccgttggcaccaactgctttagcagacagggcctgggcatcttcaccggtgtagacattgaaatcatccggggtattttgaaccagatattccaagtcttccaatgaggtacactgcttaacgccggcgatgttggcgttatgtgataattcgaccaccgtatcgttagccatcgtgacgccggttcgacctgggatgttgtaaatgatcaatggcactggtgactgttcagcaactgccgtaaagtgggcgatcatgccacgttgatttggtttgttataatatggcacaaccacaagggcgtaatcaatcccgggaatgttacccacttcagctgttaaacgcacggtctcggcggtattgttactaccggttccggcaataatcgtcccacgcccgttcacaatttgagcaaatcgggtatacaattcaatcttttcgtcatgactcaaagttggcgtctcgccagtggtgccaccgattacaaatccgcggctgccggtatccagtaagtgattggttaatttttccaaaccgtcaaagttgatgctgccgtcttcaccaaacggagtcacaattgctgtcataatatctgcactaatcatcataaatccctactttcttttattgggttaattattcattctgtattcaagaaatctggtaattgacttaattccctttggaatcgatgattctttggggttcagggtagctgagtgaagctgtgaatcatcgtcgacgcccaaccaaaacatggtgccgggaatcttagataataggtaaccaaaatcttcgccggtcatcgccggttgagtttcaacaaagtcggtttccggatcctgcttggcaaattcaatcaatcgtcgagtcagttcgtcgttattttccaccggcaaatagccaccctgattaaagtgaatcttgacttctgcgccatagctggttgccactccattggcgaccatttttagccggtcaacaatgtgttcaatcatcttctgggttaagccacgaatggtaccttcgattctggcttgcccggcgatgacgtttcgaatggtgccggcgtccagcttgccaaaagtaatcacaccgccttcgatgggattgacacttctggatacaatcgtctggacttggccgatgaattcggctgcggcaaccaccatgtcgttggcgttctgcggataggcggcatgaccacttttaccaatcagatcgacattgacctcggtcgttccggcaaacaaggttcccattcgacagccaatcgcgccagccggtaaatccgggttgtcgtgcaggccataaaattcatcgggccgccactttccttcaaagacgcctaattcataagcaaccttgccgccgttttcgctttcctcagccggttggaagaagaaaaccatgttgtcagccggctgatgctcggaaaaccagttgaggactcccagtgcgacggtcatatgaatgtcatgaccgcaagcgtgcatcacaccggggttcttggatgaaaatggtaagccggtcttctcgctaaccgtcagggcatcgatatcggtgcggtaaccaatcgtccgtttagggttggatccgttcacgtacaccagcagagccgtcggtaatttggggatttctcttatttcaatgtattgttgattgaaagattgaatggttttcaacaggtaaccatgagtggctctttcgtgcatcgccagctcaggatattcatgtaaatgtctgcgaatcccaattaaatcttccttcgttagttgactcattgaatcacaactttcttaaatcgtcttccagaccagtttccgaggttgtcttttcatcaacgtccttgacctttcgcgctgggacgccggcaaccacagtgtgtggggcaacgtccttggtgacaatggatccggccgcaaccacggcgccttcaccaacatgaacgccttcgataaccacggcattcgcgccaactaagacgttatcgtcaatctggaccggtttggcagatgccggttcaacgacgcctgccaaaacggctcccgcaccaatgtgggaatgcttgccgacaattgctcggccgcccatgacaacgcccatgtcgatcattgtgtcatcaccgatttcggcaccaatgttaatgatggcgcccatcatgataactgcgttgtttcctattgtaacgtgatcacgaatgatggctcccggttcaatccgggcattgatctccttgatgtctagtaatggaactgcagagtttctggagtctgcttcaacctggtaatcatcgatggccgatttgtttttcttaaggaaccgtttgacgtcagcccaatcgccaaacaaagttgcggtgtgcttttcggcaaatgccttgattgattttggaaacttgatgtccttaatcgatcccttgagataaatcttgaccggggtcttcttcttggcattgccaataaaatcgatgatttctcttgcgcttagttgttccattgtgattctccttaatgtcgttattttgtatgaacttttaatgtaatttttatcgggaactggaaacgtctcaaccagcctgtggctaaaaacacgtttgttagattcttttgaggtagcttaagctttgaaaatacgctccgggagccagatgctaacttctaagacaatcatgattcaagcccaaaatcagggcttcaatcatgattgtcttagaaaccgcatctcccggctccctccgcgctctgctctagttgaattcctcatccaacgccaccaaatcttcaaaagtttctcttctgatggcaacctgcgacttgccgttttccacaaataccactgccgggcggggattacggttatagttggaggccattgcatagccatacgctccggtgtccagcatcgccaaaacatctcccggttgggtggctggtaaatcctgcttttgaatcaggatgtcaccggactcacagtacttaccggcaatccggaccgtttctttaatcggtgcacttgggtccttggccaagaccgcctcgtatttggcttgatacagcgcgggacggatattgtcacccattccaccgtcaaccgtgacgtatgagcgaatccccggcacatctttgcggctgccaaccgtatataaattgtatccagcgggaccggcgattgaccggcctggttcaatccaaacagcgggcattggcaggttgacttcttcggtacgtttcttgatggccttaacgattgcatcgacaaacatttccggagcaatcgggtcatcatcttccgtgtacttgatgccaaaaccaccaccgacgttgacaactttggcaacataaccaatttctttgttccagtctgccaaagtatcgatcagcttaacagcagccatttcaaatccattgacttcaaagatttgcgaaccaatgtggcagtgaatcccaagcatgttcatccgctcatcttcaaggaccaggcccaatgctttacgggcctgaccgctttgaatatcgaagccaaacttgctgtcgacttgaccggtctgatcatattcgtgggtgtgggcggaaacccccggtgttacccgcagcatcacgttgatgtgtgattgtttatcttccaaaacttcttttaacaggtcaatttcatggaagttgtccaaaatgatgaccccaatttgatgttcaactgccatttccagttcttcgcgagatttgtcgttgccgtggaaactgacccgttccattggaaagcccgctttaatggccgtgtataattcgccgccggaaacaacgtcgatatggcccttttcctggttaatcagttgaaacattgcaatgcaggcaaaggctttgctggcataactgaccgcaaaatcgacgccgttatcttggaacaccttttgaaaatggtgaatctggtcacggatggatttcacatcgtagaccaccagaggggttttatattgcttaaccagatccaatgaatctactcccccgatttccaagtgtcccgcttgattggttgataactggtcgatttgattgctcatgttttctcctccaaaatatctttttgtgaatgatggtgtggtgaggtgttggtgggttggtagaagctgtgtctgtcgaggcttgtcgcgcaggaagcacgtttgtcatgattcttgcgtgctcccttcggcctccgaaacacgtttgttaggctcttttgaaatcccttcggccttgaaaatacgctccgacggccgggtgaaaccctgcctagcctaccagccctcgtcgcgcaggaagcacgtttgttatgattctttgagctccctgcagcttccaaaatacgctccgagggccagaggctaacttctaaggggacctttgattaaagttccaaaaccgggaacttcaatcaaagtccccttagaaaccgcctctaccagccctcgtcgcgctcttaataaaaaaatctcctcattcggcgttcgccaaacaaagagattcagaattttagttcaatatcattccgtatcatttgtcgttagcgccccgcagccgacttatccgccgcgacagtccatagcctcttaagctaagtcccagcgcgccaagtgctacctcacatggtgcttcggcaaccgcccctttcattagcttcaaagttcaggtaggaactccactaattactgatgttggttgcaacctctaatgatttaattcacataattctataatgattctcataaaatgtcaaccacttttatgagtccggatgcaaattcatgcaaaccaatcacgataaactgatgactcttgcaaattaattcaaaactgctaaaattcgttttaacaatctctaaccgaattgttaattaatgggaatatccagggagtgaatgaaagttatgaaagtcgttaagtttgggggcagttcgttagccgacgccgcccacgttcaaaaggtgattcgaatcgttcaaagcgatccggaacgaaaggtggtcgtgacttcggcgccgggcaaaagattcgccgatgatatcaaagtcactgatctcttgatcaaatatgccaatgcgatcatcgatggaacggatgccaaagccactgttgcaaccatttttgaccgttaccaggaaattggcaatggcttccatgtttcaaaaagcgtccttgatgatcttaaggccaaattaactgccctgcccgatcaatcatatccaaacgacgactacctgatggccgcctttaaagctcatggtgagcgattgaacgctgaattatttgccgcctgcctgactgaggccgggacccaagcgcgcttcgttgatcctagcgaagccggcatcctgttaagcgacaatcccaatggcgccaccgttcttgaacaaacctacgacaatctcgctgatttgacatatggtgaggaaacgttggtcttccctgggttctttggattcacccaagaaggcaacattgccactttcgctcggggcgggtccgatattaccggctccattttagctcgcggcctaaaggcggatctctacgaaaacttcaccgatgtcgatgcaatcttcgctgccaacccgaaaattgttccggatgcccgaccgattcataaaatgactttcagagaaatgcgtgaactttcatacgccggcttttcagttttcaacgatgaagcaatcattccagctattcaaggtcgagttccaattaacgttaagaacaccaacaatcccgatctcccagggacattgattgtccccgaaaaagattttacttcaaaaaaaccggtgaccggcattgccgcatccaaccgattctcagccctttatctccacagatacctgctgaacaaggaagttggctttaccctcaaaattctccaaattctgtataaatacgatgtttcctacgaacacatgccatcaggaattgacgacttgacgatcatatttgaccgcagtcagctggacagtgatacaattaaaaaaatgtgtcacgacattcaggttgaactgaatccagatacgttggattggatcgacgattacgccattatcatggtggtcggcgaagggatgcgggcaagagtcggcacgattgaaaatatcatccggccattggctgaacacgacatccccgtccatatgattaatcaaggggcgtctagaatttcaattatgctgggcactcgtcaatcagacgccgacgcagcagttaaatacatttaccaacatttttttaaagaagatccttccgttaaccaacttgaataccaggcggaagtgtagaggaggcgcgttatggttcaattactcaaagttcatggatcacaaaataagttctttatcttagatcaaacagctttacaaactaaattaagtcagcccgaattggtggccttggctaaacacattactgaacctgaaacggggctcctcgatggtgccgacggcctgttggtcattgacgattccgaccatccagacactttaggcagcatgcaggtcatcaacaccgatggcagaattgcgtcaatgtgtggcaacggactgcgcaccgtttcccgttatctgtcagacaaatttggcaaagatcaattcaaggtcgaaacgatggatagtgatctgcatgttcatcgtgaagcggacttggctgacaacgtgccaaccttcagcgttgaaatttctccggtgacattcgctaaggaaaccctgccttttgacaatttaggcaccgatacactcatcaacaaggccgttcccgaatttgcgcccggccttaaattcaccgcaattagcgttcccaatccccacttaatcagttttgtggacgaggaaaccatgcactcaaagaccttggggcaactgggcaagatgctcaacgaccccaatccttatttcccagatggtgttaacgtcagctttgcccagattctcgaccacaacacgctgttcgttcgaacttatgaacgtggtgtcggcttcaccaatgcctgtggaaccggtatgtcggcaaccagcttggcgttttgcctcaaccatccggaaatggccgactttgacgaactgatctcggtttataatcctggtggcatggttaagaccagggttcacagccgcgatgataccttctcaattgacttgatcggtaacgcgactttcactcacaagattgaaattccggaagccgatctccatgccaatgatttagagcatgcacaggtcacagaaacagatgaacaaccggcatacctgagatttgtggaaagtcttaaaaaccaactggttaaataaacaagagtcgaacacaaggcatcttgattgcagaatttaagtaaaaaagcgagttattcctgttttggaatgactcgcttttttacttgaatggccgggatcagccgatggttccacgtttaagctagctatcgcggcccagacatgatcaacaaattagtctgtcttagcctcatttttcagtgtgctcattgacccacacctcatggattaattgattggccaacaccttgcaaatcatttcaatcagctgatcctgcatgaaagtggtcgcgtcaaagtctgccggctgcccattaatggcggtaatccgcatccgatcagtttgaatttcaacgttatatttggcaaaagtatcaacaatcgcctgtaatttttgcgcatttaacatttactgacctcccagccgcagctttagtcgccattcgtcttggcggacttggttcggcttgatgcgtaaatccagatagggcgccaccaacagcaagaaatctttgacgtcttcataatgtgatttgcttgagaagtaatgattggctttgcgttgggacaacttgtcaattttaatctgcagcttgtttaaatagtcttccaccagctgaatggtattttcccgaatactggcaatctgggcaatcttttcgtcgtcaggatcctcaatctccaactcttcaaccaactggtaatggtttaattcctggtcatcaggattaatcagttccaagtcaccgtcatcaactgcggcagcaaaggattcgccatccgttcgcgccaaataagtgggcaattcttccccggtcattttaaccagcaaaacgacttttcgggcaatcccttggccaaatttgatgtgaatgacaaaattctttttgccgatataattgacgttgtctaaaattaattgtgggttatgggtaaccacttcaccaatcgcgaaataagtcgcccgttttgttcgataaatctcaccaaattgtggtgtcaattctacacgtcctttcgttgttgctcataagcatcataatacgttacttgaagattttttcaaagtcgggattttccaaacatatgttcaataattttgtataataggtattagataattcaaaacgaaatggaggggtcgtcatggccgtacaccaagtcggtattcgagaactagtggaatttttactgcggaccggtgacttaagccccgtcatcagcagtgagaatacggcacaagaaggcagtcggatccaccgcaaaattcaacgcagccgaccagcttcttatcaatcagaggtggcactgaaaacctcgatccagtatttggatgacgaatacgtcattagcggtcgagcagacggcatcgatgaccgtgacggcaaaccgttgatcgaagaaattaagacctccgacttggaattcagctcggtgccggactccacccttcaactttattggggccaagtcaaagtctatgcttacatcgtcatgcatcaagcagatattcgatcagttgatctacagttgacctacgttcagacacctgatgaaaaaatcaccaccaagacccagacgattaccaaaaccgactcggaactcttcttcaccgccttggtcaccgaatttgagcaatggatcaaactccggcatgaactggacgaaaaccgaatcagttcagcgaaaaaactccaatttccattttccgactaccgccccggccagcacaagttagcaaccaatgtctacaagaccattcttttggaaaagcacttgtttgttgaagcgccaactggaaccggcaagacgatttctaccctttttccggcaattaaatcaatgggtgaacagctgatcaaccgcattttttattttacggccaagcagagtacccgtcacgtggcggaaaacaccatttcgatgatggctgaacaagggctgaaattaaaaagcatcaccctcaccgccaaggacaagattacgttcccaactgaaaaagaactgccacctgagaacaacccctacatggtcggctactatgaccgcgtccggccggcaattaaagatattattcaacacgagaatcaaatcaccaaagccaccattcaagaatacgcagagaagcacaaagttgaccccttcgaattttcactcgacgtcagcctgttttgtgatgtcatcatttgcgactataactacttgtttgatccccaggttcacctgcagcgtttcttctcatttcccgatcccaccaactgctttttggtcgatgaagtccataatctggtgcagcgatcacgggaaatgtattcggcgacgttggaatcatcaccgattgatcccctcttagaacagttggtgaagaaaaaggcaagcaaccaaaaagtcattaaacggcttgaatccttgaagcgctcatttaaacgttatagcaaaccagcctcagaagtggttgataagcagattgctcaactggctccactggataatttcaataacactttggagaatctaatcgaaacgattcaccagtggctggcaacccaagccccgagtgataccgttgacgcggtagtcgactattatctgcaatgccgccgctattacctgatcagcaccttttatgacgaaacctaccgcacacggatcatcattggcgatcacaccatcatttttcgccagttctgcatggatcccagcaagcagctcaaagcctgcttgaaccttggccgggctgcaatcctattttcggccactttgagcccgatgtcatattaccgacaagtcttgggtaacgaggaagacagtttgggaatgatttcacactcgtcatttccaccccaaaattgccaggtgattatcgccaacaacatcaatacactatacgccaaccgggaaaatagtctggagccgatctgcgagaacatttacaccatgatcactcaaaaggttggccattacatgatgttcttcccttcaatggcgtacctgaacgccacattgagtaaatttgtcgagctgcatccagatattgacgttatcaaccagcagccggaaatggacaatgcggcccggaccgcctttttggatgcctttcgcacggaagatcatcaaaccaaagttggttttgctttactgggtggcattttttcggaaggcatcgatctgaaaaatgatcagctgattggcgtcggcattatcagtgtcggtcttcccggcatgaacaaagaatccgacctcatcagagactactttgactcattgaatggtcaaggattctcatttgcctatcagctgccaggctttaataacgtcagccaggccgccggacgggtaattcgcactgacgaagacaaaggtgtgatcgttttgatggatcaacgcttcaaccaaacccgttaccggcaaattttcccccagaattggaccaacattaaggtcaccaataatcccaatcagctaagaaatgtcctgcaaaacttttggcagcacggtaatcagtaagtgttctcgtgccaaaaaaagcgaatgggtgtatactaataacgctgttcgttaatcgaattaaagccaggaggggtaatcttgaaattagcaatgtatgatcatcagccaacatttgtggcgctccaaaacggtcagttctggggcgttccaattattggttacgactcaatcgacgatattttaaacgattggcagaactttttggctaacgtactcattaatattaacgacgataaaatcatcgacaatgacaatgccactcaacttgatccacaacattttgagcagcccgttcagcatccccgtcagctgccggctgttggcttcaactatctcgatcacatgaaggaaatggacattgtcaaacccaagcggcccaacatcttcaacaagtttgtcagctctttagccggccctcacaactcgattcatttgagtagcgacaccgtcgactgggaatccgagctcgtcgttgtgattggccgtggtggccgcaacattagccgtgaagacgctgaagacgccattgccggctacatggtcggccaggatatttccgatcgaaccgttcaatcaatcgatggtcccagtacgcagtttgaccttggaaaatcctacaaaaattattcgccggttggcccttacataaccaccatcgctgacgttgacgatattgtctccaagaccgttaccaccaaggttaacggcgaaatcatgcagcaggcgacaattgataagatgatttttgatattcaaacgctggtctcttacatctcgaacgttattgaactataccccggcgacctgatctttaccggaacgcctagaggaactggcgttggccgtgatccgcaagtcttcttaaagtccggggacctgtttaccagtgaaattgatggtctgggaaccatcgagacaaaggtcaactaatcaagtcatttatttttaaagaatttccaatcaaaaaagctggagctaaatcgttgtgatttggctccagctttgttagtttaagttttaattgcaatttaattctgactgatactcgtcaatgttacttcttgcgtaaaattgaaacaccttcgggcaccgtgaaatccttttgaatcatggttaatttgccagactcggggtcacgcgtgtacaatgtagcgttgtcagaattttggttcaaagcgatcacaaaggattgatcatcgcttaaattaaagtcgcgaggaaaatcgccttccgttgaaatccgctgaatcaatgacaaattaccggattcatctgaactgaagaccgcaatcgaattgttcccacggttggaaacatacacgaagcgcccatctttggaaacccggatggcagcggccccattatgttcggtccagtcatcaggaatagtcgagtgaatgtcccttaaggataagacgcctttgtcggcatcatagtccagtacggcaacattgctgctcaattcgccgactaaataagcgactttcttcttggcgtcaaagtaaatatgccgtggaccatagccatcttgcatttgaagttcgctaaccggcactaatttaccgttggcttccaaatcatagataaagactttgtcgacgcccaagtcaacggccacaactctaccttccggtgtcaaattgatatagtggggatgaggaccgtcctgttgctcttttcgaaagccgagggttcccttatccatgattcggtcggcctttgaaattgagccgtcatcggcaatccggtaggtgttaaccgttccggcatgataattggcggtaaagactaactgcttatcttcgtcaaccgcaatgtaagccggtgaagtttcctgatcgtgaaccgaagcaattggtttcagtggaaaatcatcgctggtaccatcccattcaacgaagccaccggtcacgtctcccttatcatctttgactttggtgatcgcgtagatccgtttttgattggattccgcaacgtaggttgggtcaatggcgctgccaacaaacgttaaattttgtaatttttgattttcagtatctaattctaactgataaacacctttactaattcttctggtataggttcctagcaagtatttttctatcaaaattttccctccaataaaagtttatgtcttcattatgccacagataaaacctaaccaaaacacatttgaaagctttttcacgaaaggaacaaattttatgacatcttttgaaaaatttcatcccgttctcaccgcccacttaacccttgattggctaacccaaacaccggtaaaatccattgacgatctgttttccaagccggcagttacaaccgcaaaggccgagaaaatgcccagccaaattctcgatactgttaaagagatcaatcacataatgcgccgggtaatgaacgacaaggaattgacttggggaattaccgactccaactcagacgcgtttgttggcatcatcagcctgcgtggctttgaagaagccaccccatcgggatcaattgaattcatcattgaccaggatcaccgtgagtatctggcagaagttgttgaaagagctatccgattttcccaggatcattttgaattcaatcagctttcaatcacgtttaatgatgtatcttcacaaaccgcaaaagaactgagtggaattggttttgtaggcgacggcgaacagcggtttaccatccaactttaaactaatttcaaagtaacaaaattattaacgacaatccaattcagaatcgttgcatatccagaccaagcatattagaattgttctaaagtaacgattggattataataacagtgaagaataacagaacgctcctcatggaggtgccaataatgacaaacacaactttaaaacgttccctgggtcaacttaaaaaacagggcgtccggattactcctcagcgagaagtgatcttggattatttgattacccaccataatcacccggatgtcgaaaccattcgcgacggcatcgaagacaagttgcccaacctcagcgtggcaacaatctataacaccctcaagatgctggtcgacaatggcttggtcattgaactgccaaataacgatggcggcatccgttatgactattttggcgtttcccattaccatgcaatctgtgaaaattgcggcaaaatcatcgacatttttgatgatgactatcccgaattagtcaaacacgttcaacaaaccaccagagaaaaaaccgactttctggtaaccggtacccaattagaggtcaccgggatttgcccggattgccagcgcaaactccacctggccaagcttgccaataaatgattattacagcgttaaactgttgatatatcagtcattagctcgataatttaagaattttgtcaagaactcttaatatgattgacaattagtaccgcaaagcccacgggtacgcgttaaatcgctatccgtgggctttttgtccggttgaattgtatcatgcaaatcgtatatattaatgaccgtagctaattaccactatgtaaaaataaaataaacatttaaaacgaaacttaaaaaaatctgcaataaacacttctgaagggaataattaatttgaaaaaaagagcgattgtaacagccctttgctcgctgacactggcggcaatcggcatgtttggactaagcagcactgcgggggctagcagtgtcaacgattatattgccaataacaatatcggccatgccagtgttacctcatcggtgtggagcggttttccaaagaacgcctaccgcaacggaaccggtaagcctgaaggggtcgtggttcatgaaactgccaaccccaactcaacgatttataacgaaattgcgtacatgaagaagaattataataacgcatttgtccattctttcgttgatgccagtcgaattatcaacatcgccaacaccaactacttggcttggggtgccggctatccggccaatgcccgcttcgtccaatttgaacaggtcgaagtccacagcaagtcagcgtttgcccacgaaattgccaacgcagcttactacaccgcctacattttggataagtatggcttaaagcctaatgatgcagcgtatgatggcaagggaactgtttggtctcacgggggtgtctccaaatatctgggcggtactaatcacaccgatccagccggctactatgcatcagcaggtaagaaatacttcggtgccagctatacgtttgcccaattttatcaattggttaagacaacctacaataatttggcagacgatggtgcggcccatgggtcactaaccgcttcatcagcaaaaacagcgtatgacaaggtcacatacgccaaagcagatacaaaggcgtcattaggagacaactacaagtcatacagattatacaatcacgttaagaattcacgatcaggggtcaaatcctattcgtgggcctcagttgacgcttctgttggtaagaaggtctatattgatgacatcgggactaaatcaaacggtcacgactggtatcggattaccttctccaccgacagtggtgcgcaaaaatattgggtctacgaaaaagcccttgacctaatcaattgacatcatttatgaattaatatatgattatgacaatttagaagaccaagtagtgtgcgtacagagaaagtgccgtcggctgaaaggcatttaagaacacgaatcctatcttcaagacgattgccctaatccggcacggatttttccgttataaaacaaaaagtgtgaagcctggctttgaatgagaatggtaccgcccgttgtgggtgtctcaatttcaaagcaggctttttttatacaaaaatatggggtgagcagatggacaaacggattattaacgcaaatcgaatcgtggtcaaggttggtaccagcagcctgatccacccaaacggtgcggtcaacttgaagacttttgatgagctggcgtacactttgagcgcgctgaataaccaaggcaagcaacttgtcctggtttcctccggggcaattggggttggcttgaacaaaatgcacctcaagaaacggccaaccgaaattggtgcccagcaggctttggctgctattggtcagtcagagttgatgacgctgtttacgcaacgattcgaccactatctgacagacattgctcaggtgcttttgacccatgatatctttgattatcccaagagcaaccagttcgttatgaacaccttcaattgtctactgcgggacaatgtgatcccgattgtcaacgagaatgacacggtggccactgatgagttggaccacaaaaccacttttggcgataacgaccaactttcagcaatcgtggccagccacgtggatgcagatttgctgatcgtcttgtcagatgtcgacgggttctatgatcaaaatcctaataaagtcgctgatgccaatctcatcagaaccgtgagccacgttgatgaaaatgaatttggtgttgccggcgggaccggcagccgctttggaaccggcggcatgcagactaagctgctggccgccaaacgaatgcttgacgaagaccggatcatggttttggccaacggtgccgatccacgcattatttttaaaattttagccggcaaagatgtgggaacgatctttcaaaaggagagtgtagctcatgaatgacaaattaatcgaaattggcaaaaatgccaaagctgctgcttataaattgaacctgctggataccgcgaccaagaaccgaatcttaaacgaatttgcgatcgccttggggcaaaacgctgagctgattcttaccgctaatcaaaaagacttggccaacgccaccgacatgcccagcaaatttaccgaccgattaaagctgacttcccaacggattgctgacatggccgagggtctccgccaagtggctggactcgccgatcccatcggtgatatcgacaagggctgggagaatgacgccggcttaaacattgaaaaaaagcgggtaccgttaggcgtcatcgccatgatttttgaagcccgccccaacgtcactgtcgacgcctccgctttgacatttaagagtggcaacgccgtcatcttgcgtggtggcaaggaagccatcaacaccaatttggcgctggctgaggttctccgtcaggttctaagcgacaatcagctcgacgaaaatgccattcagattctgcatgataccagccacgatacggccaacgacttgatgcatttgaaccaatacgttgatgttttgattccacgaggcggggccggcttaatcaatgccgttgtgaaaaactcgacggtccctgtcattgagacgggtgccggcaactgtcacgtttacgttgacaaggatgctgagttacaaatggccattgacatcgtcgttaatgccaaagtccaacgcccatctgtctgcaacgccgctgagaagctgttgatccaccgggatgtagctgaaagcatgctgccggcaatcgctcaggcgctggaggaccacggcgttgaacttcgtggtgatgaagccagccggcaaattgtctcctcaattaccccggcgactcaagaagactggtcaaccgaatacaacgatttgattatggctgttaaagtcgttgacgacgagcaggccgcaatcgaacacatcaatcaatactccaccggccactctgaagtaatcatttccgataactatcaaagcggtcaggaattcttgaataaaatcgactctgcctgcgtttacgtcaatgcctccacccgatttaccgatggcttcgagtttggcttcggtgcagaaattggcattagcacccaaaagctccacgccagaggacccatgggcttgaacgaattgactaccaccaaatatgtcattcggggcaatgggcaggttagaaaataacgagtttaataagcatattgatgagaccgggagactgggacaaaatgaaagattctgttccagcctctatttgcgtccgaatgttatctggcagaactgtgcgccaataagcagcttccggccgtataaggggattacccaaacatccaagccctggatatttgggtaatccccttatcctctggaagcaaaccgcttattggcccacgctgccgttttttattgaaaatacgctgtctttcacttcctttttctgaccagatgacgtatactgtatttagttagccggctaactaaatacagaaagggggggaccaaccgtgagttattacaactttgtcgatcgacccagcaagcagcggattcaagagatggccgatcaattacacttggcagtatcacctgatgcggtgcatttattcttggattttcaactcgcctatcgggaagtcgaaaagaactatgaaagtctggtggcgagttttgacctaagcgaatccaggttcatcatcctgatgttcttgtattatgcagatgacaaacagctgctgccctctgagattgcacacaaattgggggttaccaagccaacgatcagtaagctgttgcgggggatggaacaacaaggccttgtcagcagtcaccagtcttcaactgacaagcgggttcgggatattcagttaacacctgcaggtgaaaagctgctgcgaacttttttgccctataactatcggtcaagttccctactatttgaagattttactgacgaagaaaaacaacaattcgcgcatttactacgaaaactactcaaatccaaagacaagatccaacaactggaggaagactatcatgaacacagaaaaaattaatttactggaaacttatttaagtctgtacattaaccccatggacgttttgaaagccggtcaaaccggtcagtcgccctatgtgattttagatgttcgaaatgcccctgcccaggttaaaaaagaccagatcaaaggcgcagttgccctgcccgccaaagacttggcagctcatctgagtgaactggacaaagctaaaacctatgtggtttatgactggaatggcggcacaatcttgggtaaacaagctgttttgatcctgctcaaagccggatttgacgcattcgaacttgccggttccctggaaggctggaaaggcatgaacctgccactggaaaccattcaataattttggacgcatttcatttgaacaacggacaccaagaaggccgaaacattagagaatcctgatgtttcggcctttagtctgtctattttaatttacttcagtaaatggtgctgttgcagatattgcttagccacagccgcggccgaacgatgtttaacggtcacttggtaattcatctcctgcatgtcacgggttgtgattttgcctgctaatcgactgagtgcgcgaaccacttgtggatgcgtcttggcaaactggtcggtcatcaacggcgcgccttgatacggcgggaagaattgtttggaatccttgagcaccaccaaatgatactccctgatttgcggatcggtggtgtaagcgtcggtgacgtcgacccggccatctgccaaggcgacataccgtaaagagggctccattgtccgaactgattttaattggaaatgataggcttttcgcaatcctgggtaaccgtcggactgctggtaaaagtcgggatcaaaggcgccggttaattggctgccaacccgttgcaaatccgcaattgtgcgtaagtgatactttttagcggttgactgacggacggtaatcgcatagccgttttggtaggccattggcttcagataccgcatatggaatttttgactcaaggcatttttagcatccctgtaggccaattgaggctcgctattcacctttttgggggaatgaaccagggattggagaaccgtgccggtaaattcaggataaacgtcaatttggtcgctctgcagtgctttgaagagaaagctggtcccgccgaagttgggtttaagttgaacttttgtctgtgggctctcttgtttgaccaagtctttatacatattgatcaaaatttccggctcaccgcccatttttccagcaatcgtaaccgtttgggccggcttgttgaacaaggaccaccctaatcccgcgccaccgaggatcagtactactaagacgccgattcccagctttttgaaagaaaattgagataagactttgattaaccaactggcaaccagtgccaagatggctgataagactgcgccaacgattaaggcggcattgttgttagtctgaatgcctaacaggatatatgttccaagaccgccaccgccaattaaagcggccagggtggccgtcccgatcaccaggacagtcgcaattcggattcccgaaagaatcatcggcatcgctaatggcagctcgatccggaacaatttgaaccgtttggtcacgcccaaagcgtcggcagcttccaacaacacaggatcaatgtgggtcaggccggcataggtgttttgaaagattggcataattgcgtacagcaccaaggcgataattgccggtaccgtgccaatcccaacaaacgggattaaaattcctaaaactgcaaggctggggatcgtctgaatcacgccggcaatttgggaaatgatttcgccgatttttggccggttcaccaaacaaatcgctaaaggaatcgcaatcacgatggtaatcaagatcgcaatcaatgagatttcgatatgctgccaaagggcttggatgatggcagcggcatttttatcaacatatgccacgacttcgtcaatcatttgtcggctcctttcccaaatcggcgacataagaaatcaagtcactttgcgtcagaatggcaccatccaccaaaatcagctggccgggatttttttccaacagacccgcccattcatagactgtctggctgttctgcagcgtaatcgcctggtcatctttgccaactggacgccccaggccggcattaagcacttgttttaaaagtctggtgccggaattgtcgacgtcaaagaaccgtttgacaaactcatcggcaggattggccatcaaataatccggctcaccttcctgtaaaagaaccccattatgaataaccgccaatctatcagcgagtaaaaacgcttcgtgcatatcgtgagtcacgaatacaatcgtggtgtcaatttgttgatggagattcaaaataatcttctgcagttgcctacgggataccggatcaagggcactgaagggctcatccatcaacaccaacttggggcgggcagccagggcccggacaatgccgacccgctgagcttccccacccgataattcgtcgggcatccggttcaaaaattgatcagggtccaaattaactttgctcatcaattcaaccacccggtcatgctttttttgagccggccaacccaagttatcaagttgaatggtggcattttgttcaacggtcatattgggaaacagcgccccggtttgcagaacgtagccgatgtgtcgccgcaatttttgtaggtgactgtcggcgacgtcctcgccgtcaattttgaccgtgccgctggttggtaccactaaacgattaatcgtcttcagaagggtcgttttcccactcccggaaggtccgaccaacacaaaaagctcaccatcatcaatggtgaggttcaaatctttcaatgcaaattggccgtcaaacttttttgtgacattcgtaaactcaatcaatgtcgatcacctcgtaaaatccatggtgttttaaatatactcattttgacgatcgaacacaactcaatgctttaactgtgctttgtggagtcgcttcaacttgaaactcatcagccaagtcgtaacgggaatcgtcgtaacgaccccgattaaggaaaccacaatcgcgatcaattccgcagcaaacaccttgtcgttaagaatatcgccgaaggaataattcaagccatagaaccaaatgaataacgccaacgaactgccaaagaagccaaagaacagagtattaacggccgttcctatgatttgtttgccaatcacggtgccatccaagaagagctgttcacttttaatggcttgatgttgagttataatttcatccaagccagaggcaatcgcaattgcggcttccgcgaccgctcccaatgaactcagaatggcggttgcaatcgcaattttcgtgaaatcaatgccgacatacgttgaaaggccttcaagttcctcgctgtcttccaaaccaaaaccgccaacctgggcccaatattcaatcggaataataatgactacaatcaatatcaaaacaatcaccgaagcctgaaaggccgtggttgaggcgttgtcgctggcactgctccaaaaaatagtgattgacagtaaaatcacgctggcgacaatcgtgacgataattggcggcaggtgaaaggcaatcagcacaatcgtgaaaaagagaatgccaaaattaaccaccaggctgagaaatgaggtgataccctgtttgcccccaacaatgatcatcaagaccagcagaacaatccccaaggctgtaatagctcccattagcgttcatcccctttaatccagagtccggcaaaggcactcgataaaattaccgtcagaacgatcccaatgccgctaatcaggctggaagtcatccccaatgacatgttcatcgaaaacgaatagtgccaggtgttgccattttttaagtaaagtaaggtcatcgccagggtttcggccatgaagatgaagaacaaaacgttaatcaggggccccataatcgatttgccaatttgtctgcctgatttaaaaatcgccattcgagacagttccgggcgctcctgcttcaacgtcgccaaagaagcgacaatatcggtggcctcatccatgacggctcccagcaccccaatcaggacttcggcgataaacaacggcttgggcagctgagtaacgtactgcatcgactcataatagataccccgctcgttggtgaggccgaagacgatcagcgtaatcaagatcgttgccgccgtcgcgcacagcaccgccgacagcgtcaccagcattttcttgctccagcccataaccagcagtaaggtcacaaagcagaaaatgaccgccaaaacgctaaaaatccagataaccgcagccccgttattattgtggtcaagcttaacagctatccagaacagaatcgtgttgatcaggatgctggaaatcaccgtcacacctcgcaatttaagaatgacaaataacaggctgatggcaatcgcaaatagaaaggcaatcggtgcatcccgcttaatatctttaacagtcgcgtgtagtttaggctgagtatgtaacgtaataaagagcttttgtcccttggtatattgatggtccattgcatgcgaatctgagtaggcattcttaatgcttaatttttgaccagcatacttcccgttggtaatcgtgccgaaaagctgctgattgtggtaatgatcgacattttgaaactcatcggtcatcttgattgctttgccgttttgcacccggtctactcgataaatggtctgctggtacaggccatcattgtgctggcaaaaaaaggccgctaaaaaacaaaaggcgacgaccaggacaatctgaagccacgtcattttactcgttaatttagagttcatattgcacatcttttcagattaattttagaattattgtaacatctgtggaaatgaaagcgtggatttatttagaatcgttaggaaagcgaaagattcaccggattaaaaaagccggtgataaggacaacgccttgatcaccagctattcatcgggttattacgaaccctgttactcattatttttcataatcaacaaccatcacgttaaccgttgaatgtcggacaacgtaagcagttgtggaccccaaaatcgctctggatatcccgttaaccccggactttccaatgacgatcaacgaagcgtcatacttttcgggtaattctttggcaatttgaatctttgggactccaacaacgaagtgggtttcgactttagcgcccttcttctcggcaatttctcgggcatcgtccaaaatttcttctgcccgctcacggaacgactccatcacgtcctggcccagcgtcacgccgtactgaacataacgttgatcactggcgaccgaaacaatctgcagggtggcatcaaatgacttggccaaatcagcagcttcttccaccgccctcattgcattgtcactaccatcaactggaaccaaaattgtgtcatacatctccaacacctccgaatctgactatctaagttaatcataccattgtgtgatggaataaacataaatcaagtccggataaatctactcaaagctcagatgcgaaataattgttttgttatccgccaactcggcatgccgttcttttaaccggtcatcataggtagcaagcagatatttttcttcggcagactcaccgaccaacttagggaaatggatctcactgatttcattggtgacgatcagcgtgcaaaaagccataaaggcaacctgaacgtcttttgtcttggtatcggtggtcaaaaatttggtaaagacctccaccgcacgcttactgctgccggtgacataggagatgcacgttaaaatctcattgggccgggcaggtgataggaactggacatggtcatagcccgcggtcacaaatgatagatttcccggcagaaatttcaccccggccaatccggcattggcatccaaaattcgtaaggtttcgccgccaaattgaattcgattgttattcaactgggctggaaacacatagctttcatgaatcgccctggtgtctgagcacttgatcgtttcgatgataatcgcctccaaattcaacggattttcaatcacttgctaataaaatctacacattcaatgataaccttttcatgcctataatagcaagctttttaagtgttatacgaaaggattgtgaatgaaattttaaattattcagctgcttattgtaagcgatttcacataggtgtaaacttagggtgttgatggtaagaagtttttcattctaggaggtcataattatgaaagcagtacgtatttatggtgaaaaggatatcagagttgaagacgttgagattccagaaccaaaggatgatcaagttcaaattaaagttaaatattgtggaatttgcggaagtgatttgcacgcctatctcgaaggctggggcctgccaaccgttccttatccgttaaccggtaaaaccgtgccaattacgctggggcacgaattctcaggtgaaattgttaaagtcgggaaagacgttgacgacttacaagtcggtgaccacgttgccgttgaaccacttttagcttgcggcaaatgtgaaaactgtcgggcaggaaactataacttctgtaaccgtgccgtttcaactgatggcgccggcaacttcctgggcttctcagaagatggtgggatggctgaatttgccaacgttcaaggggtctttgcccacaagatgccaaaagacatggactttgaattaggtgctttggcagaaccaaccgccgttgtttacgaagctatcaagaagagtcatttgcgtgaaggccaaaacgttgctgtcatgggagccggcccaattggcttgctggaagctgttttagctaagatcgcaggtgccaaccacgtatacatcgttgatgtttctaaagttcgtttggacaaagccaaggaattaggcattgaacatgtccttgacccaagccaagacgacgttgaaaagatcatcaaacaagacttaccaaatggtgtggacattaccttcgaatgtgccggcgttcaagcaacctttgattcagcattgaaagttacgaagcgaaccggaattattcaagtagttgccctctatgcaaaaccagttaccatgaatatgactgacgacctgattatgcaaggtaaagacgttatcaccaccctctgctacaacaactcattcccgaatgtgttaggcattattgataaccacaaggatctgttcaagaaagttgtcactaagaaagttagcttggataatgcattggaagacggcattaaagctctctcaaccgataaatcacaagttaagattatgatcgatccatcactgtaagcatcaagtaagttaacgagaaagtaggaagactggtaacgatgaacatttttattcatcgttgccggtcttttctttgttagagaagttgctcattgggcttaaaaaataaccaacagatattcaatccatcggcaaaaacatatgttataatcttcatatgaaaggaatgacatatatgactgatgactccgtttcaatcaactcaatcgttcttattgataaccgacatttgtcggaatcggaacggatttttaaattactcagcaatcccaaccggctgcagatgctaaaagtcctcgcgcagcaggaactgaacgtcagtgaactgggaaatctgcttggtttggagcagtcctacgtttcccaccaattagcattattaaggaaacatcagctggtgtcatcccaccgcgaaggcaaagccaactattatcgactagatgatccccacatcctcgacgtcatcaatgagatgctcgagcatgctgatcacgttatcaggggtaaaaagcatggagagtaacactgattcacaaacactcgtcgaccgcagcctccacactgaatacttttcaacagcctggatggcgttcgaattcatggttgggttttattcaggtctcaaagccggctcaattctgttaatcgcatttgggctggacagttttttagagattatttctggaagcacgctcatttggcgactacgaaaagaaaatactggtgccggccctgaagcaatcgaacgggcagaaaagcgctcttcattaattgttggaatcgttttgctgttgctggctatttatgtcaccgccgtgtcactgtttaacctattcactcacgcaacggcagacaccagttattctggtatcgccattgggattgcctcggttttattaatgcctattttgacaatccggaaacggtcactgggcaaagcgctccactcggatgccctcgtcgaagatggcatgtgcaacatcacctgtgcctacatggcagcgacagtcttaatcggcgcactgttaaccgcgctgctcaactggtggtgggctgactcagtcgccgctttgattttagtgtattttattgccagtgaaggatgggaatcgtttcaggaagggtataaaaagtaaagtccccacacaattaacgcaagtatggccaaagcatctccaattctattctcattttcatcattttgaatattacattgcggaaacgtgggacgtaaagcagtttccggccatataaacaggcaatccgaatatccaagttctggatattcggattgcctgcttatattctggaaactaaccgcttcacgtcccactctgaattacattcccataaccagccgaatcacaccaagcgagataacccccaccaccacaatcacgagcagattcttggaaatgactgctgccagcactgtcggcagtgaagcaaggaaattttcccagtcaatcgatggtaagtggccgatatgttgaacaaataaattttcaaaccataatgctgacataatcgcaattggaacaaaactcaagaattccacgacgcctttagacagctgaaactttttcagcacgacaaacggggtaattcgagacagccaagtgacgatgcccgtgccaatgattgtcagcagcacaaaattaaaagaaggcatgtttcatcaccaccccaaagctgcaggccacaagggtcaccagcaaaattaataaactgcttgggatgaagatcaagcccaagtaaattgcgaccaacacaaacccaaccacgatcagttgcaagttgaatttgattgatttgtcactaatcaattgcagatacagtaaaccaatgaacatcgctaccagggcaaagtccaagccgaatttttcaggattgctgatgaaattccctagaaccgcgccaaccaacgaagaaagaatccaagtcatgtaagaaatgacgttggcggtattgaaccaagcgaagttcagatgattgtcagaataattcagcttgttcatccctaaagcaaaactttcatccgtcagcagtgtcccaaccaaaatattcttaaacatgctgtcatgcttaaaataagaggccaaagttgtgctcatcagaatcatccgcgagttgaccaaaaaaacggaaaaaataattgaaaaaatgggactgtgggtcaccagcatgctgacaatgacgaactgtgccgacccagcatatgtaataatggacatcaacgtcaccaacagtgggcttaatcccgcggctttaccgacaatgccgaaagccacaccaattcctatgtatccaaataccgttggcaatgtatcctttgaagcggcagaaacagttaaatcaccattcatttaacacactccttctttgtttttattttatgtagctgaaaacgtgtgccaaaaggccgcttcctatgcataactacgaataactttccgagctttcagctaaaaaagccattctaggttatgctacgccggccatgaaatgccaagcctacgtggcggaagcaaaaacgccttttggcacactctgttattgcattagtaaaattttaatggtgttctaatttaaagtcaatgatatttagataagaaaatcctgaaattcagttattgagctgaacttcaggattttgttagttagccagtgctctttggtaggcatcatacgtcccagtatcaaaacacaccatcgtgacatcaagtagcgcgtcaaacgttcgaatggcgtcaatggcaatcttagcggccttatcaagtggaaagtcatagacccccgtgctaatcgagggaaaagcgaccgtttggcaatgattttcaactgcccgtttgaggctattcacatacgaatttcgcagcaattgcggttcattgttatgtccgccacgccaaattggcccgggggtgtgaatcacaaatttcgccggtaatctaaacccgggtgtgactttggcttctcctgttggacagccgttgagcttgcggcaggcctcgtcgaactctggaccagctgcgcgatggattgccccatcaacgccgccaccaccgctcaaagcggtattagcggcattcacgatcgcatcaacctgcatcgtggtaatatctcctttgatcaacttaaattgtgccatggtttcacatcactttctatgggctttttcccatgctttgatttgttccaaacgttttttgaagcggacttcattgccttgctcggtcggttcataatacgtgtggccaaccagagaatccggcattgtctgcatattagtcaacttatctttggcttcgtgagcatattgatagcccttgccataacccagcttggacatcaacgaggttggcgcattgcgcagttgcagcggcaccggctcgttaatcgagtgcttgacgtcggtttcagcacccagggtggccttataaaccgcattggacttgggggccaaggacaagtaaatcgcgcactccgtcaaatggacgttacattccggcatccccaaaaattggcaggcctgaaatacattaattgccacgttcaaggcgttagtatcagccaaaccaatgtcctcactggcaaaccggaccattcggcgggcgatatacaagggatcttcgccgccacttaacatccgcgtcagccaatatacggcggcgtccgggtcgctatttcgcattgatttatgcagcgcagaaataatgttgtagtgctcctcgccgtgtttatcgtacagaaatgacttggtattcatcaactggtggagattgtcggtcgacacggtcaccttgccatcctgcttgggactgttgttaacagccatttccaaggtgtttaaggcaactctggcatcgccattggcaaattcggcaacttctttaaccgcttgatcgtcaatctcaatcgtttcttttggaaaggctgctggatttttcagcgtctgatgaattagctgaacgatgtcatcggtctccaaaggttgcagcacgaatactttacaccgtgataacaaggcggaattgatctcaaacgatgggttttccgtcgttgccccgatcagagtaatgctgccccgctccacaaatggcaaaaaggcatcttgctgggctttattgaatcggtgaatttcatcaacgaaaacaattgtcttgccgcccatctcgcggttcgcctcggcgtctttcataatctctctgatttctttgatgccgctggtgacggcactgaaagtgacaaacttggcctgcgtttttttggcaatgatctccgccaaagttgtcttgccaacaccaggcggtccccagaaaataattgagggcaactggtcactttcaataatttctctcagaactttgcctttgccaaccagctgatgctgaccgacaaattggtccagtgtctttggccggacccggctggctaagggctgattgccgtcctggttgccggcaaataatgattcctgtttcatgaagacacctcctgacaaatgaaactgatatgtatatgcctattatacgaacacacgttctaaacgtcaactctacctttattttagcgcaatcagctttcattgaccgaatttcgcaacttatggcctggctgatcgtcttcctctctggtcatgtcaaaatcacccggattaataagacgctcaaacaacgcaatcaatcccagaacaaatcgtgaattgatgggtgataatttcccctcaacaataacaaacaggttataattaagctgaatttacgggctgtctgtttgtttttttgagggagatggcaaaatgtcatataacaataacttctatcgggagccggcattttggctgagcatctgtgcggctgccgtgggcttgatgtccctatttcttggtaatgcggtccagtacagcatcatctggtggctgcaattattgatcgtcgtcattgcactgattgggattttttatttcttttcgaaatattcaaaggatcaggacaataagaataaacatttataacactagaatcatcaaaggcgccccatctctaatcagaaatgaggcgcctttgatgatttaactatgacaaattaatccgttttcgatacttcctaaccagtccgaggcctaacaaccccagccagccaacaatcgacaaagcggtgaacaagccattgaatttaactccacggctttgaatgctgattttagcttgcttgacggtttgtggaatagtgagtttaaaggtcccccgatttgaagttgccggcttttggatggttttgccattgaatttgaccgtgtaattcatcccggcatagtggacaaatggtaagtccaatctggttccctctttcatcggcacggtcagctgataagcaagggaattgttgcctgggtgcagactggccgtggcgatttcaaaccgctgtccatttaaaatggtcaccttgttggcgagatcatcaatgtgttttccagccgtcaccggtaagtaatcggtccgcccggaaccgttatcggttgggaactgattctgataatcctggttgttcaccttgtaattttgcaggttcaggttggaacgtggaatttgatgcgttggcgttgctttgtaggttaactcaggctgactggtgcggttgaactgattatcatacgggttctgatcggtagctacgttcattgaatacatcgctgaataatcaaatgaattaatcagacaaaggcttgcaacaatcaccagtgcactgacgccaattgttctacgattgaactgggttgccaacagataactgccaaaagcggcaatgaacatcactaaaaccggaataatgcggtgcccactttgaatggcctcgattccattaagcaatggaatgtgatgaattaaattccatgggaacaagttggataacacaaacaacgttaccaaactactaaagtaggcatagcgaccaattggcggcacccgtttgatgaagaatcccccaaagatcaacaccagcaataaaatgaggccgatccctttgttggccagactctggttcagccaggtaaacaaactttgcggatctgcatacagtgtttgcggattcggtcgcatcaatttttggctcatcgccaacaccgcgatcggtccccaaacgatcaggctcaaaattaaactatagacggcggcgatgccaatcttcatcaagcgagctgcccgttctttaaccggctgcttggtgaaaaaggccaggtaaaacaccaataaggcgatgaccacaatcaacgtcgtcggtgccgtacatgatcccggtaatcccaatggtgagcaggtaccaacgattactgtcgtcaaacatcacttcgtaaagaccggcaaaggccagtgggatgaatgggtaggccagaaattcaccaaactgagtggtgataatttccatgaccaaataagtcgtcaatccatataagatggcaaaataaaatgaaattcggctggacttggaaaccaatttcatactgtaataagcaatcaccagtgtggcaaacacaaccaggacataggcaaaataaatcgcgctaatcggcgaaagtacgaaccgcagcccggcaaatatgtacagccaaatccatgggtagcaggccaccaccgcatccccaatttgattaaatgtccgggtggcaatgtggctgaatggcgctccgttttgaagattggccagcatttcctcaatccggctcaaatgaaactgtaagtccgggccggaatagacatgcattgtcagccaaaacggcaaaactgcaagcaaagatagacaaaaaaagccgaggttgatgaccagcccctgatgctggcgaaacttggaaagtaattgttgatacataaaaaatggacctcctaataaaaattagcggtcccccctgtcgctgttgtattttatgatacgagatatccggtcaaaattcaaatcttattctgacattagtgaatggtacaaaaaaacaactcttccaaattatgaaagagttgtcttaatggggaaaataacacgtgtaaaaagattaaacttaacggtcaatcgtatctgcagtcatgtagaatacgtcagaaagtgaagtggtcttgtcagcaaacttcttgttcaaaatcaactgacgaaaatcttcgactgagatattttcagtatctttgattgggaatgcctgaccggtgtatgaaccggttattaacgtgatcaccaaaccattcttgctgtccaaatctaaaagatgggtttgtggtaaacaccattttaaaggaagctgatcttttttgcccgaacagcgttcggattaattttacaatctaccaaatgaacttggtaattctcaaagtagatcccatcatcataactaccggacaaaaacttgtgagttgcaaaatagtccgaaataaaatcattgaacttctcttttgaactcagtgcttctttaaattgtgtttgagttgcgactgtcatcgtaagactccctttctctcaaaattgtgtctaatcaaataacaacgcacatctatttttgtaaatggtctttatgaatcatctactaattttcattttagtccgtcagtcgcattgtgcaagtgaaaagctaatgaaaacgttgtcagaacgcaatttgtaacatttgcattctggcaacgtttccaattttatttattctttttcgacttttctggaaccttttccaattcagccagcgctttttccaattcggccttctctgattctggcaggtcagggtacttaagcggtaattctttcattcggcgatcaatgatgtcagaaacacaaagtctggagtaccatttatcgtctgaagggatgatgtaccaaggattggtcttgttggctgtgtgctcaatcgcatcctcataggctttctggtaatcgttgaagtaacggcgttccttaatgtcagctgaggcaaatttccaattgtgatccggcagttcaattcgccgcttgaagcgatcccgctgctcatcggcagacatgtggaggaagaacttcaagaccatgaagccgtttcgggtcaaatagtcctcaaagaaattgatatccttgaatcggccatcgaagaatttgttatccacttgatcaagcttggtgatcgagccaatcttggcattgacaatcatttccgggtgaacccgactgatcagcacatcttcgtagtacgaacggttaaaaataccgataatcccatgttccgggatgtgtcgatgaatccgccacaggtaatcatggcttaattcaattgaggttggcgacttaaagcttgtgacctcaattccctgaggattaaccccgctcaaaatgtgtctgatcatactgtccttgccagacccatccatgccttgaaagataaccaagacaccaaaatggttttgggcatacagtttcccctgcaaatcttgaagcgtcgcaatattattttcaattcgtgctttaatgtcatccttgttcaaatcttcaacggtggcggaagttggaatcttggcaatctttagatcccgatccccgttgtatcgaaaagatttctcacgatcaaaaattttcttttcgtccatagtgttgccccctaaggaatcattagtaacaactttataatagcttatcccttggaaaaataactaagagaatgtttattctccacatttatttctcatattgagtatactagattacatagaattagtttcatataacgctgttttagtgtcgcttgaaacatctatcaactctctttgaaggaggacttaatttgaatatcttaaaagcaaactcaacagctggtggccaatccgaccaaccagccgaggattcaatcgacaagtcgttattaaaggacgacctttacaaagccgttaacggccgttgggaaaagaccgccaagattccggccgaccattcgtcaacgggtggcttcatggatctcaatgacaacatcgacaaacaattaatgagtgacctcgatgacatcatcaaggaaaatcagccacacgaggcgccattctccgaattcttgaagttgtacgaactggcccgcaactataagaagcgggatgcagacggtggcgaaccactgaaaccgtatttggaaaaaatcgaaaacatcactaattttgatgatttgaacgaacttttgccggagctggttaaggaaggttacccactgccatttggcttttgggttgaacctgacatgaagaatacgcaggttaacgctttattcgcagcggttcccggcctatttcttcccgaccggacctattatgaaaacaataatccagcttacaagcaattgatgccggtcttcaccaagatggccagccaattactggtattagcggactacagcagcaatgaagcggatgaaattgtcgaatcagccaaacggtttgatgccaagattgcaccaaacgtcaaatcggctgaggaatctgccgattacagcaagatgtacaatcctcagaagtttgcctacttctcagaatcaagttctcatctcgattttgtcaatctggccgacgcgttgtttggcaaggcaccggagcagatcatcgtgaccgaaccgaagttttacgagcgctttgacggtctggttaacagtgacaccttcaaagacatgaagaactggatgctggtcaatatggtccgttcagcatccggctatctatcagaagaattccgtcagaccggttctgtcttcagccgtgcgctatccggtaagaaggaagcaacgccacagaagaaatcagccttctatctggcagaaggaacatttggccaaacaattggtgactattacgccaagaaatactttggcccgaaagccaaagctgacgttgaacacatggttaaaaacatgatcaacgtctacaagaaccgtttaagcaataacacctggctgggcaaagacacccgcgagaaagccattttgaaactggacaaactcgaactccaagtcggttatcctgaccacatcgatgaattggaatacaaattcaaagtgacccctgaaaatgaaggtgggaccctatttgacaacatgtccaagtttggtgcgattaccgtccaagacacctttgagaaattgggtaagccggtcgaccgaacaaaatgggaaatgagcgccgcaaccgtcaacgcttactacgaaccatttaagaacatcatcgtctttccagccgcaatcctccaagcaccgttctacagcttgaagcagacttccagccagaactatggtggaattggcgcagtcatcgcgcatgaaatttcgcacgcatttgataacaatggttctctgttcgatgaattaggtaatttgaataattggtggacgaaagaggaccatgaatacttctccaagctggccgacaagatgatcaaggaattcgatggcattccatttgcgggtggtaaggtaaatgggaagctgacggtttccgaaaacatcgccgatgccggtggtctgagctgtgccaatgaagcggccaagaatgaggccgactacaacttgtatgacttcttcatcaactgggctaaagtatggcggatgaaggccacggaacagtacaagcagctgctgttaaatatcgacgtacatgccccagctgaattgcgggccaatgttcaagtgaagaatttggatgatttctatacaacttttgatgttaaagacggcgatggaatgtatcttgaacctgataagagagtgaaaatttggtaggaagcagacctattgaaacgctttttatccaaataataatcgaataaacacaaaatggcacctaacctcaaaaaaagtttagtgccattttttatttttactatttgctattagaagtgatcaataaccagccaaaagtagcctttgccggcccttaggcaaaaagcacgcttcttaggttcttaagtgctcccttcagcctctcaaatgtgttccgacgggcctgaccctaaacccagccctcagccaaaaaacacgtttattagattcttaggtgctcccttcggcctttaaaatacgctccgacgggccaaaggctaacttctaagcgcactttaattaaagttccaaacccaggaacttcaatcaaagtacccttagaaaccgcatctcccggccctcgtcacactcttattttttgccccgcatacaccgccgcaccgaccattcctgcttcatcgcccagctgcgccatctccagcttgcaggcttcacgggccaccggcagtgaatgatgcgccaaggtttcgcgggtatatttgaacaatggctctccggcagccgagacaccgccacccaggattaacgtttccggattaaacaaattaatcacgttgcccaaaccaaatcccagcaactcgccagtttctttaaagacttcaatagctgttggatctccttttgccaccgcttccgagatcaatttggtggtcagttcctgcccttgtgacatccattcgccaaccaagctggtttcgccgtcagccagtttttcctgcatggttttgacgatcccgcgagcggaaacataccgtcccagacagccggtactgccgcaagcacatggccggccgtggcggtacatgttcatgtggccgatctcaccgacactattggaagcgccatataacacttggccgttaatcagaacagctgcgcccagcccagtaccaatcgtgaccaggacaacgtttcgatgacctcttccggccccgaacgccatttcgccgtacagattaactcggacatcgttgtcaatgaagaccggttggcccagcttctcatgcagccactcggcgaccgggacatccttccagtcggtaaaattcggtgaaaaaatcgaaatccccttttccacatccatttgcccgggaatgccaaagccggcagccaaaatatcatctgaggtaatcttttcctgagccattaattgctggcagcacgcccagatccgcttcagtacttcagtgggaccggcctcttcatgagtcggcttatgtaatttttggaccgtttgaaaatcctcatcgaacagtccggccttaatgttggtcccgccaagatcaacacccaaataatattttgtcatatcgtccacctcacaacagcgatcaattcaatcaaaaaacgcttacttactatgataataaccgattagactgcataaagcttccaaaaacattccaatcaccatcagatacatgacgaccatattcatgcccagataaagcagaatgcccatcaccaaatacaacagtacaaagaaccaacgtaaccaaatattattaaccatttcgatcccctccagatccattttaactcttacattagaatctttacaatctgtgaacaaataatttgtaaaaacgcggttttaatgtaaactaatgattattaggatataatatatgtaaagagtaattggagaggtgataccatgaacttaacagagtatcttcattcgcagctcaagtttttaaatgaccagatgagttccgctaagaaagataaagacgaaacgatgcaatatctggtagattcaaagattacagaagtcaaattaatcttggaagccctccaaaagggaatcatcgatggaataagttaaaatgtggccgattggccattttttatgttttaatagactagtgcgtaataaagattgattaaaaaaggaagtagaatattgattacattaaaatcaccacgagagattgagaagatggctgaatcaggtgctgttctggccggcgttcataaggaacttcgcaagatgattaagcccggtttggacacatgggacattgagttgtttgcccgccgctatatcaaagatcacgacgcctacccttcagaaatgggctttgacggctacaaatttgcgacatgtatttccattaacgatgaagtcgctcatggaattccccgtaaaggcttgaagttaaagaacggcgacatcctcaaagttgatatgtgtgtcaacaaggatggcttcgaaagtgattcttgctggacttatgctgtcggtgacgtcagcgatgacatcaaaaaattaatggaagttactcgcaaaggcttgtaccttggcattgaccaagctgttattggtaaccgtcttggtgacattggaaatgccattcaaacttacgtggaagaccaaaaccacatgggcgatgtccgtgaactgattggccacggcattcagccctccattcatgaagaacccaacgttcccgcatatggtgtcccaggccaaggccttcgtttgaaggaaggtatgacgatcaccatcgaaccgatggttaacaccggtacttgggaaattgccgaccgttacgacaagaaggatgactggacatactacgtttcagccgatggaactccttcagctcaatatgagcataccttggccattaccaaggatggtccaaagattttaacttcccaggatccagacattgacgcaaaatatctgctttaatttaaatcatcaacaaacggccgggacatttgttccggtcgtttgtttagatttgagaaccgcccctccaagcggactcctaaccgcttggatccgctcacttttacaggacagctcctccaagcaggagtctccttgtaagcacctcgcaagcaaatccccaaaaaccgggaatttacttccgaggagacttacaatccgactcctaaccgcttggatccgctcacttttacaggaaggaatgattacatgaacaataagaactttaaatttcctgacactgctgcctacgaatttgttattcaagcactcaaagaccgcggggtgacctatgaagacatcgccgagatggcctataatcttcaaaagaaatttgtccccaacattcaaatggacgaagtcaaaaaagacaccatcgacgtgctccacaaacgagaggttctcaataacgccatggtcggcctggagctggatcgattggcaactgaaggcaaaatcaaagaaccccttgaaagcatcatcatgaatgattccggcgtttttggcgttgacgaaggtattgccttaaacattgccaacatctacggcacgattggaattaccaattatggctttgttgaccgggaaaaaactggcgtcacaaaaaaattggatgaagccaaagacggcacatccaatacgtttattgatgatattgtcggcgcgattgccagtgcggtctcagcgaagatcgcccaccggaacaactaacgccaaccatgtgatttttgatcataatcccgctttttaataccggaaacatagggattgcccttaacaaaataccgcagtggcttggtcgcccaagtcccttgattcgcaaccccgattcgattagattcttcaatctgaatggggatttttttgtcatcttgatgaatatttaacttgctgttaccaaagatttgcatattcatatctttatcggcaatcccaaaggcttccatcaatttccccggaccattggtgagctcaacgccatgccgggtacggttctgttccataacggctaacccaattgttggctcaattgcccggatcaaaatcccctgggggacatcttttgcttgagccgcaacatccaagaggtatcgcccatgaatcgaatagatgtacactgttcccggaggcccgtaaagcggttcgttggaagctgtccgccggcccttaaaagcatgggcagccgaatccttttgtcccatataggcttcggtttcaacaattcggccacccaccagacctttgggggaatcataggttaaaagcatccccaacaatttcttggagatttcgtcggtggtgccgttagaataaaatgggtcttggtccaaatcaaccatccctttcaacaaatggaggttatcacatgcaattaaaattagaacgaatttacgataagccgcaggatctttccggctaccgagtcctcgtcgaccgcctatggcctcgagggatttccaaagtcaatgccaagctggatgaatgggaaaaagaaatcgccccatccaaagagctgcgcacctggttttcacatgacccagaaaaatttcccgattttaaggaaaaatacgtcgctgaacttgacgccaacccacagaccaaagaattcctcaaactaattggtgatcagctcaagaatggcaatgtgatcctgctttatggtgccaaagatcgtgagcacaatcaagcagtcgtcttgaaacaatacttaaccgatcacttaggccagctttgacgaatattggccagggtcaattctttagtggactcaaagttaatatcggccattgttagaacttccggatcaccaacaccaattgagaccacgttagcagcgttaatcgactcgacgccgacaatcccgtcatcgatgccaatacattgatcaacgttcaggtggagcatctcagcggcctttaaatacacatcgggtgccggcttgttatgcttgatgtcggccaaattcacaatcaatggaaagtaatcttccaattcaagtttgtggatctctttaggcgcattagccgaggccgaagcaataatcatctggtagtggttcaaccggagctcagctagaaagtcgcgaatccccggtaagatatcatctggattcatgatctcaagcatttgctgataaatggcgttcttcttgtcagcaagtgcttctttttgctggtcagaatatttgccaaccaacccgccgacacgtaaaatctcgtttaacgaatcgatccgatcacggcccttgatcgcctcttccaggtcttgattccactgcacaccaatctcttcggcaatctgacgccaagattggctatggtaccgccaggaatcggtaatgatgccgttgagatcaaacaacacccctttgatattagtaaaatcagtcatttcaaacaccctttcttacaaaaaaagactgaaaacaagattgtgttttcagccccagcggcagcttgaattatttaacagcgttaaagatccaagtgatgccatacttgtcaacaatctggccgtatttgttgccagaagttttcttttcaaaagttacgattactttgacttcttctgattccaccactcgctcgtacaaatcctgcaacgaggaaagggcatcggaatcatgcagatcaacttcaaacatcagcgaaatcatcgaggaaatcaccggcttacctaaaaaactgtccgcacaaaaaatctgcttgcctaaaatgttgaaactggcttgcatcgtaaggtcgtcgagattgacatcgtcattaagcgacatgtcttgcgcctgcttttcagttggggattcacgttgaacatccgtggcaccaaaaacagtttgataataatccaaagcttctttggtgttttcgaacgtcaaatatggaattaaattaatattactcattaggtcagcaacccttacattttaatattattcaaagtttagaatacctttaaatacaatagttgtcaacgtcaaccgtctgccaatgcctattctgataggaaatggcgtcctttttggtaataatttttggaaaagtgatagacttaaattaaacggatcgggaggaactatttaatgaaacttgcaatcacaatttttgtattaaatgcgttatacatttcgattaataccttcagaacaatgctggttgtgaaaggccaccaatttttagcccccatcgtggccgtcggcgaagagtttgtctacgtgatggcgttagcgatcgctttgcagcatattgacagtccgttaaacatcgccgcatatgcggttgggttcggtgttggtatctacattggaattgtcatcgaagacaagatcgccttggggtacgtcaactttgaggtaaccgtccagattgacccgacaaatccgattcatgcccacaatgaagagttggccgaaaagttgcggaatctcggttacggtgttacggtcagccgtgctgaaggccgctcaggagcccgcctggttctcagcattctggctcccagaaaagccgaccgtcgtttgatggaacaaatcaaggaaatctcacctgacgctttcgtcatggttcaagaaccggttcaattatccggtggcttctggagtaaagaagttgaccggcgttatcattcaaccaatcatatgcactaatcgtcatcttcatcgaataagccgagctgtttgagactatttttaatatcttgaactgaagttggcgtcgttggtgccgcttttcgatgaatgggctttggctgccttggagttggctgttgtttggtcggttgaggtttaggaattggctgtggatccggcttatccggggtaacggcggggctggcctgcggatccagctgacccatttgatccatggtttggtttaacaggtggtcgacaaaaacatttccctcatcgcctgcgtgccccttggtccaataataccgaatgatcgggaaatctctcagattggcatcaactgcttgccaaagctgcttgttatgcagcttcgagccgtcgctcttgttccagccgcggcgtcgccaaccagccagccaacctttttgaatcgcatccaaaacatactgggaatccatgactacaccaatccgctcattttgcagaccctggcgtttcaaatacttcagggcctccaagaaggccattatttccattcgattattcgtagcaccaaattcgccaccggattcgaaatatttttgactaccagtttgaactaaaaatgcccaggctgctttatcgctggcttttacgtggccgccacgatggttgccgtggttgcgagaaccgccgtcggtgtagacgataatatcaccgtccggttggactgagcggcgacccgtcgaagcctttttgtgagatttgtggtgtggctgagtgggcggcgttgtttttttcgccccgttgagataggcattggcttcggcttcggtcttaaaacttttatattgggcaccggaaaatcctttaaccttcttttcggcctcgtcccaactggtaaagatgccggtctttcgaccttttttaactgcgtaatatttcatgaaaatcatggctcctcaatgtaaaaatttcagaaaaaatgttaattattaattataatgtttctatctactttgcaattagataaatctatgcgaaaatgttaataaaagggggcaaatttaatatgacccaaactaaagccacattgatctcggtcattgaagccaaagcacttctaaaagaccagtcagatcaaataaacgagcgttttccccgattaaaaaaacaaggtaagtatattctacctgattatcggttaacaagaaaacgtgaagctttcaagattcgaaagcatacatttttacagcaccacgcacgttcctacgttgcatttgattccgagaacggacagacgctttggatgcacaactttccaagcttgactgaagccttgttttggttggataccggtcttaaacctaccgataccgacactaacacatcgtataagtcatggaaagatctgcacgaagatgacattaacgccctcaaagacattttgaaggaacgttctcgtaaacgcaaggaagcggcggctgccaaaaaagctgcctcggttcccaaaaagaaaccggcagctgtcaaaaagtcgacagtagttaagaaaaagaaagctaactaattcgttattcgatcctaaaaaaggtatgactgtgaataaaagatcattttgttcacggtcatgcctttttattgtccatttagttattgataatgaccagcaatgtcgtctggactaaaatccttagtgaattgacgatcataagccttttcataggcagcaactttttgttggtaatcaatttggcgcatcttttcagcagcttcgcgctgtgatgtggccgacttttcaaccgcatccggataaatcggcggtaacacatggaccgtatagttgatgccatgcggatccgatttggtcggggcgtcaaccatcgaaacaaagcaggacacgattggcacattcaatctaacggcgtagtagtatgctccccgctcaagcggccgcggtttgcgatagttgaaccacatttcccgttccggataaattagaattgattgtttgcgtgccaagctactttgcaaaagggcaataaaccccttgcccatgtaattgacgctgtcgctgacaggtatcgtatcagcgtatgtcatcaaaaatcccagcatcccgggcattttaaggttggtgagctcaacgacaatcgacaaatcaggttgattcagggctgatcgaaccagcaggctgtcaatcgggctaaagtggttacaggtaatgattgccggccattctaaagcctttaaattgtgagttccctcaacttttaaattgggattcatcatcctcgcagccatattcatgaccgaccgggcttcagctgcccgccaatggtaacgtttagttttgtgaagcttcaagaagtggtccaacacctcatgctgctcggtgagtgtcagcaccggatcatgtagttcgactttttgattaaattttccctgacggacgttttcagcaatgttttgaatcactttatcacgctcgccaagctttaccggtgtaaaagtcatagggcaatttttactccttgcttggcccttgcgtaaaatgtcgttggggtcttaataatatcaacggctaattgaatcaaatcggactgattcttctgatcacgggcaacttctttaggattcatatctgcgagctgctgttttaacatggtctcgtaatcggtttgtttggcataggtccaaaaatagctttgtcgaggggcatcatcatagcgccacggcttggcgaataagttatagtgaatcaaccaaggttcaacatcctgtggcgtagtgatttggatgttccatgacgggttcaaataataaattcgatttctcgcgatggcattcatgtagtcctgatccggggccaaactcttgaaatggtacttgttcaagagctgcaaaaagtgttcagcgaattttgaacggcgcatttcggcgaggttcatcaacaacacgccggaattaacgtatttctgtgaatcaatcccaacggcttgttcagcatagtcaatcgtttccggagtgtggccgatgaagtgatccggcactgcgccaaccaagttatcacccagctgggtatcaaataactcacccacatcctttaaaaccaccgtgtctgcatccagatagagtgccttatccaatttggggaacaattcagcaataaacagccggaaataaattgtaaaggtaaagtaatcgctgcgaagtttgttattcttatcggtaatttcttgcttcaagcggtcgttaattgaaacaaactgaattttgaggttgtccgtttcaaaggctttaagccgcccttgattatcgctattgagattatcacacaacacaatcacctggtaatacctgtccggtgatgtatgcgcgaccagtgaagccagtgaaactgccaaataaggtgcataattgtcatcgacagcgtaaaaaattggcacagtttgattttccataatgaatcccccttaaatcaatgtgattgatgctggtaggtcataaatgacacgttgctttggtgactgcgggtcaccatttgggcatgaatctgatcatggagcttttgttggcgttgcttgcgcggaagtgacttgtccggcataaacggaccgtcaaagtataccacctgcttgggtcggctaaacagtcggcctttttgatatgtaatcgtcatgctgtaactgggcagatcggcagcgaccggataatggaaagcgccgactggaaacggacgaatcttggtgtaatacggccaaacatgggcttcgggatagataaacacccgttgatgctggtccaatcgagcattcatcgctcgctgaaattgaatcatttgtgataattttgcgggtaggatcaatgccccacccatcgtcaagagacggccgacgatgggaataccaaggttggcaggttccgcgatcggatacgcccgcctgggtactgccaccagcatcggcaaaagcgcatcccccagcggctgggtatgattggcataaatgaaggcgccccgtttgccttgggtgcgcagacaccgtttgttccgaaaagacgtccgcaaatacaggcgacaataaacgaagctgacaacaaccgccacccagtagacgaccgtcgccgttacgcggtaaaaccaattttgatgcagccaaatgtagccctcaggaatggtggcattttgattcttggtaaagaccacgtcatcatcaaaatcatgatacgtaaacacttttgatgcccgtttagtcattgccaatgtcaccctttcttccaacaagttaaaatcatgaacagaaccattctaccccaaatatgacattattttatcatacgggacgtttaaaaatggcaattcactaaaaatcgtcctttaaatgatgaaattggtgtaaaattaaggcttgctatgctaggatatttgggataacaatggatgtatacacatcattagaaggatttaggggataattttgatgcaagctcagtccaagaacaataccaagtttaactttaaaacatttataggcctaatcaaccgaattcacccccgttactggcaactgctgcttggtttttttctaggggttgtcgcaacggcgatgcaattgatggttcccggcatcgccaaggggatcatcaactcaatcggtcattcaatggatgtcggcctaattgttgccgtcattttactattcgttttcagtaccattatcggagccttttccggtagtattttaggcttcttcggtgaagacgtcgtctataagctgcgaacgacgctgtgggataagattttaaccctgccggtgggttattttgaccaaaccaaatctggcgaaataacctccaggttggttaatgattccacacaggtcaaggaactgctggccaattcggttcccaaaaccgcaacttcgattctgcaattggttggcgcattggtcttaatgctcatcatggactggcggatgactatcattatgtttatcgccgttccactcgtcttgatctgcctgctgccaattgtccgccaatcccacaaagttgccagagcgagacaggacgcactggcagatctcaatggtaaagctggcgaaatgctgggcgaagtccgtctggttaaatcgtctacggcggaaaacttagaacgaacagccggcgacaaacggatgtatcgactttatcgcatcggactaaaagaagcgatctatgattcgattgccggacctgtcatgggcatggtcatgatggccatggtcctgggaattctgggctatggtgcgatccgggttcgggaaggtgccattgatattgggaccttattttcatttctgatgtacctggttcaaatgattagtccatttgcggttctcggccaattcatgtctgatgttgccaaggcaagtggctcaaccactcgaatccaggcattattgcaaacccatgaagaagatcatctgactggaacggatttggatattggcgatcaaacacttcagatgaaccacgtcagtttttcttatgatcagcatcaccccattttatctgacgtgtcgtttacggcagaacccaattcggtcattgcctttgccggtccatccggcggtggcaaatcaaccattttcagcttaattgaacgcttttatgaacctaacgagggcagcatcacgatcggcaataccaatattactgatattcaacttgccgattggcgccagcaaatcggcctggtcggccaagacgctgcgatcatgtctggaacgattcgttacaatttaacctatggtttgccgggacatttttccgatgatcagctttggcatgtcttggaaatggcttacgcaacgcaatttgtccaaaagatgccccagggcttggacacggaagtcggtgagcgtggcgtcaaggtatcgggtggccaacgtcaacgattggcgattgcccgggccttcctgcgtaatccaaaaatcttaatgttggatgaagcaacggcgagcctggattccgagtccgaaatgatggtccaaaaagcgctggaccaattgatggccaatcgaacaacattggtgatcgcccacaggctaagcacaattaccaacgccgacgaaatttatttcatagaaaacggtaaggtaacgggccagggaacccaccagcagttggtgaaaacaactcctttgtatagggagtatgtgaacaatcagagcgcgacaagacccggttagggaccggagtacaaagagaatcaggccatgatgaacgttccttgttcatcgtggcctgattctttttgtacagtaggttcctgggtcgtcggagcgtattttaaaggccggagggagctcaaaagagcataaccgcaccactgcgcgacaagacccggttaggacccaccaagtaggctaggccgttttcatccggccgtcggaacataagtgagaaaaatcaatgatgaacggtctttgttcatcgttgattttttttcgcttatgtggctgggtcctgggtcgtcagagcgtatttcaaaagcggcaggaatctcaaaatcccctaaccacgccaaccaattgataacacttccaccccctgcgcaccaatccaatcaagacaaaatataaaaagagccaatcattccaaaaacaggaataatcagctcgttcattaaaattctaagagcaacgcatctcgcatcgcaccctcactcagttttcaattccccttcagcatccaattcagccataatctcctgatactcggctaaaatatcatcatattcatgcaaatgaagttgctgatgcactttatcaacttcccaaggcttgaccgaaaccgtgtggacgatcggccataatttccaccgggtggagaaatgctgaaaaacggtgtcagattgaacatcctgctgctcattatatttttcaggggcaaaagccttgtgcttagccagcttattcattgcggactggtccggcataatcatcggccattttcgacagtactcccggcagcgggccagcaatttgtcttggcggatcatgtccagattcatcaggagcatccccgagttgatgtaatcaaatgctctaagttgatgatggaagaaccaacggccgtaatgatccaagacaccaacaaaatcagttccagccagtgattgatgataaaaatcttcaaacggccggcgacacacaacgtcagcgtccaaatacagaattcggtctgaaaattgcggcaccaaatcactatacagccgcaacatgctatagggcgtgaataacgtgttgatgttagccttgggcaaatccgcctcaaactgagcggtaatgtcaattttggtaacgccgctatcgacatcttcccgcttcaccagttgatccaaaaaggctgcgtgatcgtcagtcagcgcttgaaattgctgatgtcgattatacaattgtccagtcaaaatgtagatgttgagtggttcttgcgcgtgttttgtcagtgagaggattgaaataatcaaccccgaaaacatgtggtcgtctccacagtataaaatatccaaaccgcattcatcccccaattcgtgtctcatcaatcaaagtgtgtcatacttcctgataaatggcaactaatgaccttggaaattccccacaattcaaaaagagcacccagccgacgcagcaatgtgtgtcaaaaggctgagtgcttttaaattaatcttcgaaatagtttttgacctgtttgggctcagtttgaaccaagatcttaccattatgaatggagtagagaatttctgagcgttcatttaaggcgttgtagaaattatcattattcataatgatacaattagccggtttaccgacctggatcccgtagtggccagtgatatgcatcgccttggcaccgttggtcgtaataaactggtaggaattcataatatcgtcgtaccccatcaaatgaccaacgtgaatccccatttcaactgggtcgagcatgttaccattgcccattggataccaaggatccttgatgtcgtcttcaccaaaggcaacgttgatgccatcctcagataactctttaacccgagtcatcccccgccgctttgggtaggtatcaaagcggccgccaaggttagtattaactaacggattggcaatgaaattgatgtgagacattttcaggaggcggaacaacttgtaagtataggcgtcgttatacgatcccatggcagtggtgtggctggcggtaactttgtcacccatgccgctttcaagtgccaaagttgccaagacttccaggtttcgtgaagccgggtcgtcaatctcatcgcaatgaacgtcgaccagtttgcccttgctttcggcaactttcatcaagaatttgagtgactcaacgccgtagtcgcgggtaaattcaaagtggggaatcccgccaatcacgtcggctcccatgtcggcagcggcaatcatcaattccttgccatttggataggataaaatgccttcttggggaaaggccaccagctggagttccacttgatcggcaacctcgtcacggacctcaattaaagcctttaaagccgtcaaatcgggatcggtcacgtcaacatggctgcggacaaattgaatcccgttggcaacctgaatcttaagagctttttttgctcgcgtcttgacatcatcaatcgtcagctttttctttcgctcactccaaattcgaatgccatcaaataaggtgccggattgattccattcaggatcaccggccgtttgggttgcatccaaatgaacatggggatccacaaacggcggcaacaacagcttgtcggtggcgtcaatcacctgttcaccgtcgccgggttgaattgaggcggcaattttgacgaacttgccatcctcaattttgacatctctggtttcttcagcgttttcaatatggacattttttatcagcatcagattatccctcacaatcaagtatttaataacattatagtctattttaacgccggagttgggcgcaatcggtggaatgtgcgataatacagatgacatcattattagaaattggcatttctgccaagtgaaaggtactgattctttgaacttaaaaaccaggttggcactcccgcagattttaacattgggatttctcatcatcattctggtgggaacttttctgctatcgctgccaattgccagcaaatccggtcacatgaccggctacattaacgctttctttacggcaacttcggccacctgcgtcactgggatgaccgtcgtcaataccgcgcttcattggagcgttttcggcaaaattgtcatcttgatgctcgtggaaatcggtggtctgggattcatgacctttgcggttctcctgtttgttttcatgcgccgaaaagttgatctgacaacccggttgttgacccagcaatcgctaaacctgcagtcatttgccaataccagttcggttgtgtttttggtggtccggatttctttggcgattcaagtgttgggaacggcactgatttttatcgatttttatccccggtacgggtttgccaaaggcttgggttacagcatttttcattcaatcagcgccttttgtaacgccgggtttgacttgtacgataacagtttggaacaatttcagaccgatccatacctgctctttgtcttgacgattttgattatttcgggctcactgggctttctagtctggaaggatatccttttctacaaagaagatcatcatttaagtctacataccaaattagcgttgacgacttatctgggactgatcggtctcagttttgtggtgtatatgctgacggaaggcaacttcggccaggaaagtcatttgaccatgttccagcgaatcatgaatacctggtttttggcggtcactccgcgaacggccggcttttacaccttgccggtcacccatatcacaatgggtgggatgttctttaccatgattttgatgctgattggcggaacccccggatcaactgccggtggtatcaaaacaaccacggtcggcatcctgctgatcagagtgtggtcaacactacgcggcaaacgggacgcaactttttggggccgacggttcagtaacgacaacgttacccgttcattgtcactggtcttcttggtggcagtggtcttgtcgatagcaacgatgattctaacatttacggaaacgatcccgaaaactcagggattggaatacatcacatttgacgtcatctcggcattcggtaccaccggctttagcctgggcctggtggcgcacctgagtgtcgtcggtaaattaatttttgcggcgctgatgttcatgggcagagtgggtatctttacggtaatgtattcactgctcaactcaaagcgcccggaagatgctttccggtatccggaggagaatgtgatgattgggtaagagtgcggactagggcggttagcaaccgtagtctaaggtacttccaacggaaatcgagtttgattttcgttggaagtatcttaggcgcaggttgctgccctagggagcacgcctccactaggtaaaataaaagcactaacacctctaagtgcaatgagtgttatgaatcatattttcaagctaaacactattaaaaattaacccaacaaccaaaaggagcaaaacaatgaaacaaaactacgcagtcatcggcctaggcctcttcggttccagtatcgtcaacaccttgctggaacacgaccaggaggttctggtcattgataaaagtgaagctcgggtcaacgaatttcgtgaccgggcaaccgaagcaatcgtagccgatacgcaaaatgagttagccttaaaccaactgggcatcgggaactttgacaacgtctttgtcgccattggaaccgatctggaagccagtatcatgaccaccatgatttgtgaagaattaggcgtgaagaacctgatctgtaaggctgaaaatgcccgccatgcaaaagtcctggaaaaattaggtgctgatgaagtcatccagccggaacgagacatgggtcagcggattgccctgcacgtcatggagcctaagattctcaatgatttgaagctaaagggtgaattgtcggtgattgaatttgaactgaccaatccaaaactctttaacaagacgctcaaggaactcaacttaaccaatcgctacaaaatttctgtcatcgccctttcccacgcggacgagaacggtgcaattatcccgaatcaatcaacgattaccaaacccggtgacattgtcacgattattggaaccgagaaagatgtcgaagcatttgaagccgtggccacggcataaaaatagagtcagacagcttggttagctgactgactcctatttagtgtgtatcatgatgttaaacaaatacaaaaaattacttagcaggcttttgcttcaagaaatgttgcaagtctgataattctttgtttcgcttaatatcttttttacggttaactggacgacgtccttgtacgccgtgtggatgacaaattcgcataattagactctccttattttgtattatgatttcataattccaatagactaaattattataatacaagtttaggttggaacgcaaatcaatctgcggtttctctatgatttctaatgaaatgtggtattcttaataattaaatgaacagttgaggtgattaatttgacagaacaatatccacaggcactgacaattgcgggctctgacagcgatggcagtgccggcatgcaggctgatttacatacattttttagacggcacatctacggaacggccgttatgaccgccgcggtggcaggaaatagttacgggattcatgattcggtaaccctgccgacatcttttattgaccaggaatttaaagatttggccgacgattaccatgttcgggcaagcaaaaccgggatgctggccgacacagagttgattcgcaccgtcatcaagaactatcaaaaatacgatttcggcccattggtggttgatccggtgattaccaccaagcatggtaacatgctcttggaacaaagcgcctaccagacgcttcgcgatgagctgatcccgctggcaaccgtcatcactcccaacttctttgaagcccaaaaattggctgaaatggacatcgacactcaggatgacatggtcactgcagcccagaaactaaaggatctgggtgccgccaacatcatgatcaaaggcagccaccacaaacccggccaaaaagaagtgtccgattatgtcctcctcgaatccgggaaaagtttctggctgactggtgacttcttcgatactgaccgtaaaaacgggaccggcgacagtttgtccgcatgtatcgctgccgaattagcccgtggtaacgacgtcgaaactgctgttcgcattgctaaaaagtttgttgacgtggcaattgaaaataagatccaagttggccacaaatttgggccgattaaccactgggcaccgggatatcccgatcctgaacaatcaaacaattcctaatagcgacctccattatcggataggtcgcatcataaccagatcggcagaaaggcctgggcaaaactaacgattttgctcaggcctttttactatcttaatattacctagccgaatagtgggaagctaagcacttgttttaccacactgttctgttacccaatatgtctttcaaactttttgaatccaaataacttgtcgattcggccaaagtattcttctgggatttccaaatcaaccgccttcaaattattttcaagttggctgggcttgctggcaccagtaatcaagctactgattcgtggatcacgcattgtccaagctaaagcgaaggtcgccaaatcagtgtccaactcatttgccatcttaatcagttcttcaaccttatctaaattgtcatccgttaacagcgcttggatttgatcttgataagttgctcgtgatccggctggaatcttgtggcccttacgatacttgccagtcagcaacccttgggaaagcggcgaaaatgggacgatccccaagccaagtttttcgcagacatccatcagttcatgctcaatgtagcgatcaaacatgttatattgcggctgaaccacagacatcgggtgcaagcccaacttttgaatcactaattgtgcttccaaaatttgtattgggcgccactcactgacaccgtaatagagaatcttgccttggtcgacgagatcactcaaagcagttaaagtttctgccaatggtgtgttgggatcaaatcggtggcagaagtacagatccaggtaatcagtctggagattcgtcaacgactgatcaatcgattccataatatgtttgcgcgaaagcccacggtcgttgactccgggacctgtcggaaagtaaaccttacttgaaagaacgatttcttttcgtggaaattctttgagtgccttgcctaaaaaccattcggctgccccaccactgtatgcgtcagcgcaatcaaaaaagttgatgcctttgctataagccagtttcaaactctgatcggccaaatcctgcttggctgaatcactcacgtcggtcatccagctgcctaaagccaattcactgactttgaggccttgtttacctaaattgcggtatttcattttgtttcctctcctcattttgatttgttagtttatatcttgagtttagcgcttcgagtgtacttgaagtaaaggacatttagtcaaaaaaatcgttttgggcgctgttactttgctgagttgtgctacccaggcaggcctggtcctgtaacttcgggggttgtttgactgttatctttagggattttcactgttactttgttgaattgtgctacgcaggccagactcctccgcttagataaataggaccctttgatgcaagaccagcatcaaagggtcctattcacctaatgctcggagtctaaccggcctggtgcgcacactgttttttgcaccgcgatcaacccgagtcttgtcgcacactaatccctgaacaactccatattctgcaaataagtcatctcatcagtcgaaatccgcgtttgcagcttttctgccaaagcggcatcaatttttccggtcgtcaaagagttttgaatcagctcatactcgctatggaacgcccgcatgaacatctggtagacaatgtccatatcaacatcctggccattaattcgccgatgcctggttcgatagaatcgcttgaccatgttggtctcgacaccattttcgccctgcttggtcttcaaaaagtccatgaccgcgttaaatccggcttcctcaattgggaggatattttcaccatgcttttcaaattgctcgcgccaatagacttcttccaaagccactggagcggttaaaaacgcctcttgagcacggttcagatccttatacagtctaccaacatgcagactaaacctaattctcaataagacatttttccaaatcttctcatccgcagaaaaattattcaagttcaaaaattttgtataatacgtcagctcatcctgagaaattttaccgtcatcaaacatcttctgaacggtcttcagctccacttggtggctctcactcatcaactgcctacgcaaatggaaattcggcgtgctgtccaagaccaactgctgctgaagcgaatcaatgaccacctgtgcctcggctgggtgctccttttctttcagcaggtcactaattgcggcttgaatcatccgtttaacccaacgataccgaggctgctgccgatcttgactcggtaaaatgattggaacaaaaatcgtcggcataataagactggttaagataaccaccgcagcgacaaaaatcatgatgccccggaactcaaacggctggccattaaccgtgttaggcatcgagaaagccagtgagagggtaattgtcccgttcgctccgctaagtgccatgacgaggctgtcacgccactcatggttcgatttaacacgacgcttgagcatatatctgctccaaaccagtctcaaggttccttttaccgcataaacgccaatcccaatcagaattaacttcaaaatattcagatcaggatttggagattggtgaagtgcctgaataacttccggcaacgacaggcccagcagcacgaacacaatcccggataatgctccggaaacgacttcccagacgttgctggtaaccagctgcatccgcgatgaagttaaccgtaatttgtcacgttcagatccctgaaccagcccggcggcgacaaccgccaagatgcctgacaatgctaatttttctgccagcaaatacactaaaaatggagacatcaattggatcaacaccatgataatcggcgtatcgtcgttataacgaatcaaaaacagccgggcactgacaatcgcaactccgatcaggctcccaaataacaagccgcctaaaaattcccagagaaacatcgcaacggccagttttaacgaaaaggtccccgagacaaaggcagtcagcgacaagtcaaacagcacaatgccggccgcgtcgttaaacagcgactcgtgctgcaagatccctgcctgctcttcagcaatcggattggcctcaaaaatcgaattaaccgctgaagcatcagttggcgtgacaatcgccagcaatgcaaagcatagcgttagcggcaggatggtcatgacggcgtgtaggcctgagccgaccaccaaaacggtgaccagtaccagcccaactgccagcgacaaaatgttggtgatcgaccggccaatccaaaaccgtgaactgttttgagcctcattaaacagcatcggcgcgataattgccaaggcaaacgtcgacgggtccaaatggaaattgcggtataccggcagaaccgccagcagaatccccagcaaaatcaggaaaaatggcagcggaataaacgagacgtgtcgcgcgagaatattagcaaatacgaccgcagccaaaatgatggtcagtagtagtaccatgtccattacattcacccctccgcttcaatatcgattctagtttatcactgattggacaaaaaaagccgtgtcgacacttggacacggcttacagatgaaaggcagatatatttctatttaacctaccacttatccgggctccaaatccgcccgtccaactcatcttgtgattgctgcgctcgcttttcctgctccttagccaacgcaatagctgcttgataaatcgatttattaacaaatgattggtcagcttcctttagttgggtcagctgttgaaccaaccaatccgttgtatcactcatccctattcctcctgatcgcgaatcattttcacgtcttgttttaaactttcaacattattttgttggtcttcaatggagttgatcaccaaatcaatggcctgctgaaggtccgctgacttatctgatttggtatcctgcagccgagcgaccagccactgttcgcggttggccaaactcaacggcatctcggcactcaagtattccagatagtcgaccagcaacttctctttttgggccggatccaaataaccaaattgattaacaacaaacggctttaggtaggtcatccctgctttattagcaaacgcctgaaatgggcgcagcagttcggaaacggtaaactgctccgggcccccggcttggaagtcggcctcggcatcccccaatgagacgacgattcccaattctttcgtctttaaggatcgtttggcaacgatatagtttctggtgaaaacatcgtccatgaatcgttttaagctcgccggggatgagtaccagtacattggaaattgaaaaacaatccggtcaaaatcccgcagtgcattttgttccttctcgatgtcgattgtcccggttgctgtatataattcatcaatcacctggtatttcacgtcgtccagggaataaaagctggttttaagaaattgttgcgttcccgaatcctcaaattgaggatgggaaattaagatcaatgttttcattgttatcctacgcctttcataagcctttttcatttcgtttccacttaaaatcatctatattaagattgtaaaccaaatcataatcaaaggagagttaaactatggcaatttataacgttcatactaccttaagagacattggagctcaaacaattaacactgcgggggtccatcagtttgtggctgacgagcccaccaaattccgtggcaccgatgccggccccaacccggttcaatacttgctgggcgctgtgggtgcctgtctgggtgccagcgccgcatcattggttcaccgccccggttccaatattaaagtggaagaatttgaagtcgaagttaccggcgaaacagaacgttttgccgacaagtcttcacgggtcaaaagtattcatgtgaaattgacctgccacaccaacttggataaggaaggcaacgatcgattcatcgaggataccattcatctgtgcaccgtccacaatactttgaaagattccgtggaatttacctttgagattacggattaatttcgatttaattgaagaataacattactgataccgttagcacttcatattatggagtgctaattttattttctacaatttagtaaattgtcttgcgaacattggtgtacaagcgtttctggcaattaaatttttgtgttaattgtttgacctcattaccaatatatgatactatatagttgttcgaaaggggaatggatgttcgccctcgaacattttcaacaaatacaggaaatcatttagaatatgggggtattgcctatgaataacgatatttttggaactaatggttttgacgatattttcaacgacccgttctttaggaacgcaatgtcagattccaacggccgtcaacagtcacgtcaacaacccattcaagttcaagaacgcagacctcaacagaagaaaactttgttagatgaatatggaacagatttaaccaaaatggccaaagatggcaagttggacccagtcatcggccgtgataaagagattgaacaaatggaagaagttctcagccgtcgtaccaagaacaatccagttctgatcggagatgccggtgttggtaagactgcggttgtcgaaggtttggcacaaaagattgtcgccggcgatgtgtctgagaaactcctcaacaagaagatcatctcgattgatgttgtctcacttgttcaaggaactggaatccgtggccaatttgaggaacggatgaagaagttaatcgatgacgtttcaaaggataagaatgtaattctgtttatcgatgaaatccatcaaattattggagccggctcaactggtgaaggtgacaagatggatgccggaaacattttgaagccgaagttggcacgtggcgacttccagttaattggtgccacgaccagtaatgagtaccgggacattgaaaaagaccaggcccttgctcgtcgattccagccaatcatggtgaatgaaccaagtgaacaagatacgttaaccattatcaaaggcttggcaccgaaatatgagaagttccaccacgttcaatacactgctgatgctttgaaggccgctgtcagcttgagtaaccgctacattcaagaccgaatgaatcctgacaaggccatcgacttaattgaccaagccggagcaaaagttgccatgggctcatcgctcacgaaagacaagtccaccctgcagcaagaagcagaacagcttgaaaaggataaaaacgcagcttccaagaaagaagatttcgagcaggctgccaagttacgtgacaagctggacaaggttcaagatcaaatcaagaacatcgacagcggtaccaaagtcacaacaccaaaggttacccctgaagtgattcaatcagttgttgaacggatcactggagtcccggtaaccgacgtcaacaagaatgaagtcaaccagttgaacaatttggataaagacctgaagaaagaagtcatcggccaagacaaagccctggatgcaatttccgctgccattcgtcgtagccgggttggctttactgaaggtaaccgaccaattggcagtttcttgtttgtcggccctaccggagttggtaagacgcaaaccgctaaggcgctggccaaagaattgtttggcacgacaaaagccatgttcaggtatgatatgtcagaatacatggacaaaatcagtgccagcaagttaatcggttcagcccctggttatgttggctatgaagaaggcggccgtctgaccgagcaagttcgtcgtcatccatacagcctgattttgatggatgaaatcgaaaaggcacacccagacgtcttgaatctgttgttacaaattttggacgatggtcgtttgtcggacgcccaaggtcgaacagttgacttcagcaacaccgtgattatcatgaccagtaatgccggtcaaggtgaagccgataacaaacaaaatgtcatcgaccgattgaagccatacttcaagcttgagttcttgaaccgaattgatgatattattcaattcaactcattaaccaagcctgatctgttgaagattctcgatttgatgctcaacgatttgaaccaattagtcgacaagtcacgtgggatccacttcagcgtcactgccgacgccaagaacaagttggtcgacatgggttacagtaaagaacttggtgctcgtccaatgcacagagtgattaccaaagaaattacagataaattaaccaatagttatctgcagaatccagatgtcaaagacttcaaagtcgttgttgacaaggatgccatcaaggttgaaccagttgctgccaagcaagcaattgcttcataaccccgaaatgatcgtaaactaatttgacaaagaccagtgatgttggtatattatagtcaatgtgtttaagggttcgattttcaaaggtatttgttttatagtattatgaaataactccttggaatcactgcaacttgatacattaaaatataattatgcgctaaaagcgcaaggaggtttcatatattatgaaacaaggtactgttaaatggttcaacgctgataaaggttatggcttcattactactgacgatggtgacgtatttgttcacttctcagctatcaacaaagacggcttcaagtcattagacgaaggccaaaaagttacccttgacgttgaagacagcgaccgtggaccacaagctgctaacgttacaccaattgaagactaattcattagtttaaaatttgaaagaaccagcgatttcgatcgctggttctttttttatgcccaccttcatccaattgcctatatacatataaggtgctgaattatataatagaatggttctgaaaatattaagaaaggagaattcacacatgaacatttcaaagcacttcaatcactcgatgaagttaacggcttgcttgggtgtttgtttcggctttttgctgcttgccgaccctacatatgcggatacatcgcaagctcaaaccagcagtgagccaactgcgacggcaaccgctagttcatcaacgatagattcacctgtgccatcaagtgatagtgactcacaaacgactacggttgatcaaccaaatgaaaatgccaagtcgcaagctgttgaatcaagtaatgaacaaccgaccgtcccagagactgatgacagttctagcgagcaacccgttcctgcaaatcattcaaccgccgagacgacaaccaccagttcatcaactgacaatcaatcagatgcagatactgccaccagcaccactgacagcccagatgatagttcggacgatacgccagatgtccagccgaatgacagtcaagccacaccagctgagggtgctcagaccacaactaacaatccaactgatcagtcgtcaactactggtccatctgacaaggatcaaatcaccatcgacggcattaatcagtcaactgatcccgccatcaagcaatccagcaacaatccattgatcaatttcttgaccagcatcaccagtggcattgccgcctcagtgatttatccactagtcgccagtcgtcaaggggcacaattcatttcgcattttcgaacattgttgtccccaaaccgctgggatgtcagtcaaaattgggcggatttggatcagaaatataatccggattacgtcaaaacatactataccgacgctcaggactggtacgacaaccgtgtccaaaagcaaacttgggaggttccttttgcggacgggactggtactgccagggcaacttaccttaaaaatggtgactcgaagaagaccatcatttacggtcaaggctggacaaccgagccggagggcatggggcgaatttccaagatgttttatgacatgggctacaacgttttgatgccctacactcgcggccaaaactccagtgacggtgaatggttaaccttcggggataaagacaaacaggattgggtcaattggattaacaagattgaccaaaccaatggccaagacagccagattgttctctacggtcaatcacttggcgccgacactgcactacaatatgccggccaaggcaatttgccttcttccgtcaaagcaaccattgcggattgtggtttttcgaccatcccatctttgatctaccatttgtacactggtgcagctaacagtctcaatagcatcacttctaaaattggctggaacctcaacggctcaattccactggttccatttgatcagctcttaacggcgatgaacgggattaacaagcttgttcaaggctttagcctggatgacgtctccggcatcacagcagttaagaattcgaaattgccaactttattcatttcaactgaagatgacactttcatccctgatactgaaactgaaaccatgtacaacctgagtgcctcaactgataaaaaactgtgggtgcttgacggccacgttggcggtcatgcttcagcaagcaacgccgttcaggattacatgaagaacattgaagattttctggcttccgcaatgaatcaaagcagttcgtcttctgatgatcaactgaatgttccggcaaccaacaaagttgctgcatagcacttcaatatcaaccttggaaaaggctcagcgataactagtcgctgggcttttcttgatcaacaatcaagtttggggcagcttggctaacaaaggatttattaaaattgacccagatcaattttttaccatccaaaacgtgctaaagttaaaatgtaaaatgtttcgatgatatgtattgacatcagttttgccaatctgtattatgttaattattaactaataaaaagtaagtacactactggaggaattttaacccatgaaagaacaattattagatcttgccaagaagcgccgctctatttacgcattaggccgtaacatcaaccagagcgaagacgagattgctgacttaatcaagaagaatatcaagtgggccccaaccccatttaacaaccaaaccactcgtgccgtgatcttgtttggtgccaaccacgaaaagctgtgggacatcgttggcaaacgcttgaagtcagaagttcctactgaagaagcttaccaaaagactttggaaaagatcaacgccttcaaatcagcatttggtactgtcatgtactacactgacatggacgttgttcatcgctttgagaatgactttgcactgtacgccgacaactttgccgactgggcagaacaagctcaaggaaacgctcaatttgccgtttggacatcccttgccgaaaacggcatcggtgccaacctgcaacattacaatccactgatcgatgaccaagttaaagaagcatttggcatccctgacagctggaaattacgtgcccaaatggactttggttcaattgaagccccagctggcgaaaaagaattcatgaatgacgaagaccgcttcaaggttttgaagtaattaaattgcatgccaaaatggttcccaaccagatcacatctgattgagaaccatttttttgatacactcacttcttcaattgaactttcacaagctcatcgccatgactgacgacatcttctttggtgtaatcactttgagtaaccttgtcaccctgcgtcagcaagaccagcacggtatctttgtaaccagcctgttgaatcttgtctcggttaaattccagcagcaggtcacccttcttgaatgactggccagaatcaacgtggttaatgaagccttcaccgcgcatattcacggtgccaaggccgacgtgaatcaagatttccaacccatcgtcggaacgtaagccaatgacgtgcttcgtggtaaacaacagaaccacttggccatcaaacggcgcgtaaatctttccttccgtcggttgaatgccgatgccgtttccaggcaatcctttatgatcatgctcgtcaaccacatctgccaagttgactctcacaccacttactggtgccgcaacagtgatcgtggcttcttcagaactggtagtcgcattctcagaactagttgcttgctcatccgagttatcactaatcccttcaacagctaacttgtgctgcagttcgtcaacgatttcagcatgtttcttttcagaaatcttaaccttgaagacatagatgaataatgccaaaacatgcaagataagtgcggcccagaatgcgaccagtttgaataatgaaatgccgcctggggtcattgaagccgcggtggcggttccagtcatcccagctgcaacggcaacccagccaacaatcgcatttgaaatggcaccggacatcttatccaacatcggccgaattgccaaggtaacggcttcattccgcgtgccatttttcaactgaccatattcaatcgtatcggttaaggtcaaaataaccgccataaaaatgaatccttgtggcacataatacagaatcatcgctgtgacaaccatcgctaaattatccgtggaaacaatcagtaggatgtatgccaagatcatgctgcacatgctgacggcataaattgtcttgcgggtcacccacttgttaataattgggtaaagcggcgaagtaaagaaaccggcaatcgttggaatcagtccggtaatccagaataatcccggtttatccatgacatacttgaataaatagaacatcaagccggcagtagccgcattcccaaaaccataaatcaggtatggaaaggcagtccacagcatctggtcgttatgtgccaacgcccagaacatttctttcagactggtctttttcttagtaactgcccgcaaagcattttgcttctcgtgggttccaagagcaaccaccagggagcaaataatgcccacaacggcaatcaaaattccaaaggcagtccagcctggttggccttcgttgtgtttgccggtaaagaagaaggtcacataagtaaccaccggcacgataatgatcgtaacaatgttttgaccaaaaccggcgaagttggcggcagccgtgaacagtgaccgctcgtgactatcttcagtaagtgcaggcaccatgccccaataagacacatctctgaatgagtagaaaatatcaaaggtaatgaagatcgggataaagagaatggtgaaccaagttgcactcacccgagacaagccaaagattccggaaaacagcagtgccagcagcaaacttgaaatcgttccggcaccgattaaccacggcttaaatttaccccagcgcgtattggtgttatcgacaatgttcccaataatcggatcgataaagatttcgaccaaccgaataatgaaaattaacccggtaatcatggcaattaacttgttggcctgggctttgggaacccctgtgaacattgcggaagtgacatagaccatgaagtaagttccaaaggtcatgtagaccgcagatccacctatgttagcaaacgcaaagttgaaaatcgaccagaaatttttccgccgatctttcttttgtacagcatccaatttataaaacgcctcccagcgtgccgattcgccattacaaatgggcggttcggtatgaaaattcgtagaaaatatttccttaccaatcgagtatataatgtaagggttttcatcaatgctatatttttaccgtaaaatacccaaatttaacccaattatagtaaaatatactaaaagggagtgcgaagatgcgaattgcgtttaataaacctgcagaaacgatgccgctgtattgtgacagtgtcggctatgattggaatcagccgccaattcaccgactgaacggctattacgcctaccattggctgcaaaccgaaagtggcgccggtgtgattaacattgaccaccagtcgatttccctgcaggccaaccagggaattctcctccgtcccagagtcgcccatgaatatcatccaaccggaaaagaaccttggaaagtatcgtttttaaccttcaacgggacactctgcgattcgctggctgattttctgaaactggcagatttcctggtaattgacacggtttcaccagaactaacatcgtttattcccgaagtcttgaatgaatttaacaacaatcatccaatcgccctgctggatcaatccgttcaaatctataaatttatcatgctgctgaagcaaaaccatttactgaacaatcaccgttatcaagatgccacaattaccacgccaattcttcaatacattgcggcccactatgccgaaccgattacgaatgacaaattgtcgaaagccaccagttattcagttacctaccaaaaccgggtttttaagcggctatatgatatgaccccgctggaatacctgaccgattatcggatgcgaaaggcgaaggaattgttgttaaccaacccaactctggaaattggcgagatcgcaccaaaagtcggctttcataatccgtcgcatttcattgaccagttcaagaaatactacaaagcaacgccgtctcatttccggaaattcatttagaaaatcttacagattcaaaacagtctcatttatgaaatcaactttaattagtggtaaactttgcctacaacaataattgaggagtgatcttatcgaatcaactgttaagcgtggttggggcatcaccaacttcgacatcaaagtacttggaattattctgatgttcatcgaccacgtgcatgaaatgtttaacggtatcggtgtgcccaactgggtggactggtttggccggccggtagcaacgatctttttcttcctgagcgttgaaggcttcattcatacccataatcaaaaacgctacttgtccaggctgctggttggcttttgggtcatgcagattgggaacctgattatccaacatttcttcaaactcggcagttttggcttgattaacaacatcttcggcgacctattcattggggtgctgacaatgtatggcctgcagaccatttctcagggtcatcagaatcatcaggcagccaagatctgggaaggaattctcattagtgccctaccgttgatctttgccggcctgaccttgctgacaatgggccaaggcggcaacagcattgcctttcgaattgtgaccctgctgccaagtcccctgattgctgaaaacggctttatcctttacctgggaccattgatgtatctgttaaggaagaaccgcaactggcagatgctggccgtcgtggcagtggcaattttgtccaccggctttaatttcagcagtatgttcacgactaacttccagtggttgatgtttcttgccattatcccaatgtacctttacaacggtcagcttggccgcagcatgaaaggcttcttctacgccttttacccactgcacatttggctgctgtacattctggcttggttcatgggtgtgcgctattaatttagacaaacaaaaaatgagatgctggtttccattgagttggaaatcacatctcatttttaatttaagcattattttgtgataaatacatacaaggtactggtcgagtaccccaagctaaacaatagcccattggaatggaacttcggtgccgttgtcgagctggacttcttggccttggccgccttctggaatttgttcaaaacgtgcttggcgttagcgccgacactgtttgtcaaaatcgagaacgacatgataaacggcttgaggtcctttttatgcttcaagctgttaaccggcaccatcattgcgatgcctaagactttatcacccgataaattgacccgcaatgtcatcttgttggtatcaatcaaattgtggatgccatctttgggattggccggcagaagctgatctttgacactagccttggctttcttcattgccggggccagtttagcttgcgtttgcttcaattcagctgcctgcttttgaagggccgtcgccttttgcgccttagcctgcatggctgccatactggtagccttgccggctttcaactcggcagcttccttcttcagttgggcaccctgcttagccattgattgggccagctgttggtccttctttggcaatgcggcgccggttaatccttggttataagtcgtccgcatcttctggtaactgccaaccacgttggccttggcgaccgtgacggtttggtgcttgccatccgtgctcaatttgacagtttgttgataattcttagttggcacactaattacaaatgcaccgctgtttgttttaactgtttgcttcgtaccgccattcacagtgtaatcgacctgcttttgattactcttgcctttcagcgtcactgccaaagcattcgcgctcaaatggtgattagagaccgtcaacgttggtttaccacaaccgctcagaatgaccatcagagaagcggcagcgactactaaactcattaattttttcatcgtaagctcctccttaatcaaacgaaacgtcatctgagaattgactattataaagatcagcatagaagccgtttttagccaacaactcattatgggttccggtttcaaccacggcaccatggttcatcacaataatgttgtcggcgttttgaatcgtggacagtctgtgggcaaccacaaagctggtccgattctccaacaactgactcatcgcatgctgaatctgaacttcggtccgggtatcaactgaactggtggcttcatccaaaatcagaatttccggatccgccacaaaggctcgggcaatcgtaattaattgacgctgaccttgagaaatattggaagccgattcattcaaaacagtatcgtaaccctttggcagtttgcggacaaattcgtccacatgggcagccttggcagcttcgataatgtcatccttgctggcgtcttctcggccatatttgatattgtcgtagattgagccggtgaacagccaagtatcctggagaaccatcgcaaagtgtgaacgcagatcttcacggtccagatcacgcgtgtcgacccccttgaggcgaatgctgccgcccttaacgtcatagaagcgctccaacaagttgatgatggtggttttaccagcaccggttggaccgacgatagcgacctgctgaccgcgtttaacggccaggttgtaatctttcatcaacaattcgtcatcggtgtagccaaattgaacgtgttccaattcaaccaggttatccgtgtcggtttccactggtcggttggctttggtattcttcatttcctcttcatcaatcacttcaaacacccgctcagctgacgcaatcgtcgactgaatggtgttcatcaagttggcaagttgagaaattggctgtgagaattggttggtatactgcaggaaggcctgaacgtttcccaaagttaccgttccgttggcaacctgaatcccaccaacaaccgccacgaacacatagccgatgttgttgaggaaaatcatcaacggcatgataatcccggaaataaactgcgctttccaagcagcttgatagtatttcttattttgaacttcgaactggtcaatcgtatcttgttccttgttaaaactcttcagaacaatttgaccggcataattttcttcaacctggttgtttaacaaccccaggctcttctgttgagccgcaaaatatttctgcgatcggggagcgacgatgccgacgattaccaaactcaatggaatggttaccagggcaattaaagtcaacttccagctaatcgtaaacatcatccagagagttccgacaaaggtcacgaaactggttacagcctgggtcaaactttgctgaagggtgctggcgatgttatccatatcgttcacggcccggctcatgatatccccattactatgagaatcataatacttgatcggaaccagccgcatcttgcccttcatctgccgccgtaatttgtagacggtgttttgagaaatccgggtcatgatgtactgctggaagaaactgaaaacagccgatgccaggtacatcacgataacgataagaataatttgaacaattttttcataattgattggcagcgaagccacgctaaagccggctttctgctgggcatttcccttcatcaatcctttaaaaatttcagtggttgcttcacccaaaatcttgggtgtccggatttggaagataacactgatgatcgcaaaggcgaacaccaaaatcaggccaatcagtcgatcctgcatgtaattcagcagccgcctggtggtgccccaaaagttatggggcttttcaacaacaccttggaagccgccacggccaccatggccacgattggaggtaggttgtggtgccttatctttatcagccattatttgtcatcctcctctcgtaattgtgagtgaataatttcttggtaaaccttgttgttagcccgcaactcgtcatgggtgcctttgccaaccagtttgccgttatcaagcaccaggatcagatcagcatcggcaactgtggcaattcgttgggccacaatcacagtaatactctgctggatgtgttgatcggcccgcaaagcagctcgtaaatcggcatcagtcttgaaatccagtgctgagaacgaatcatcaaagacgtaaacggcggcctgcttgactaaggatcgcgcaattgccaatcgttgcttttgaccaccggagaagttgtccgcaccttgttcaacttggagatcaagtccagtgggatcttcttcgacaaaatccttggcccgggcgatttccagggcgtgccaaatctgatcgtcagtcgcttctgggttcccatatttcatattgtcacggatagttcccgtgaacaaagtggccttttgtgggacaaaggaaacttgatctctaaggtctttcatcgagaaatcattgatgttatgcccatccagctcaatctcacccttatcaacatcatagaatcgagggatcaaggaaaccaaagtcgtctttcctgaaccggtcccaccaataatagcaaccgtttggccgctatgcgcctcaaagtcaatatcacttaacgccggcaattcagcttggcgataacggtattcaacatgatcgaatttcaagtcgtgctgagtggctttaggatcaaggaccaccggatgctccggctgtttcatggttgatttcaatgccagcacagtctgaattcgcttagctgaggcctgtgcacgaggaatgaaaacgaacaccattgagagcatcataaagctcatcagaatctgcatggcataactcatgaacgcaatcagattaccaacctgcattgactgggcaccgattaacttggcaccaaaccagacaatcgcgacgttggttccactcatgattaaagtcatcacggggaaggccaaagcgacaatcgtgttgaccttgatggcattatcggtataatcccggttggcatcctcaaagcgatcctgttcaaattggtcctgccgaaatgcccggataacccggacaccagtcaaaccttcacggaaaattcggttaattttatccgtcttagtctgcattgctctaaataatgggactgagaagtagagtaggaggccaacaaagataatcatgatcggtaataccaccaagaagatggtggttaactgatggtccttggtgtaggccaaaaaactggcaccaatcagcataatcggcgccatcagcatcatccgcagcatgataattgccacgttttgaatttgaaccacatcgttagtggtccgcgtgatcaatgatgacgtctcaatttgatcatattcatctttggagaagttgatgactttacggtaaacgtcactccgcaaattttgccccaacttttgtgaggtccgggcagccagaaagacgttgcagaccgccgccagaatactaatgagtgaaaagccggccatttccagacccactttccaaatatagccaatgtctcctttggcaaccccgttattaacaatgtccgaggtcaggctgggaagattcaaggtcgcgatcacttgaatcgtcatgaacagcactgccccgagaactgccacgtacgagatccggtttttggcaattttcagcattttcctactccttccaggttcgttttaagattgttgtgcgcttaattaggtaccgaactatattactgctagtgcatttaaaatacaagtataagttggtaaataactaggtaaacagatacggcctattatgaacttttctgcggtgagtttcattaatgttaactaaaattttgctttagggattgcaagggttagataaccgcaaaaatgacaccgggaccatcttgtctgatgatttcggtgccattctttctatattattatcgtgtgaaaatgagtggacttgaatttttaacaagcgatccaaattttctcacatcacttcgccaatccatccaaagtgaatttaagcttgggcaacatgttcttcaggcgtcttaaccgcattctgcttatctcgttcaaggactgacttcatgtagctgtcgacgtcaaatgtcccggcaaattcggccaagtgaaccaggtttctcaagaagtcgtgggtcttggcttcgtaatgatactttaggccaaggtcgtagatgtagccgttgatgtagtccacttcggtttgacgattcttagaaatatcttgatacatcgacgggaagtgaagtgggttggaaacggtgctgacgtatttaacggtttcccactcttcttgacgggtattcaataacgtgatcccggcgcgttcacagacatcgaaagcttcatcgattaattgaacgcccaacttctcggcaactggtgattggatatactcacccattcggatcttaaacatcgtgcacaaggtgttgatgacggagttaaagacgactttggccatcaaagttccaaggaagttcttggtcaaattaggattaagccctgctttttggaattcagcgacaatcttgtgagtcatctcatcaggtttctcggtttcattggcaatgttcattgaaccggcacccttgggaccgatgaagtcgacgtcgccggctttgttcaacacagttccgatcagagcggttccgccgagtaaacgttccttggggaagtactggttaagtttttcaacgtgacccatcccattcatgcaagtgacaacgtattgtttgtcgttgaagaatcgtgaacagcgttttaagaaatcagcgagttgatattgcttggtgaagacaatcaagacatccggatcacccttgtattcttctggatagtacacgttgaccgggaccagatgtttattttgaccgtcacgggaaacgtaaacgccaccctgttggcggaccgtttcaacttgtggttcccaagtatcgacaaagtcgacatcgaacccggcttcctgcaaaagaaccccatatctcaaacccattgcgcctgcacctaatactgtatatttcataaatataacttcctctccactataaagtatgtaatcaacaatctttatcaatcccactaaagcaacccgcgatacaaaaaaatcgcccttctgtcactaagacaaaaggacgacaattggccgcggtaccaccttcatagacacttttcgtatccactcgttacttgctttaacggacaagtccgaaaccggctaacttacgctcaccgatttatgggtaaagcatgaaagtcacaatctacaatttcactaccatctctcagccgccgaatggattttctgttagcgaagcttgtagaaaacttctttcaaattgatagttcgtattatgatagtcagattagaatatgtcaatactttttgagaaaataatgtgagcagctaacatcctgacatcacaaaaaggcgactagagcaatgtctagccaccttttaattgattatttaattatggttattttttgattgattcctcatttctcttgtttgcgcttggcgtagtaaatcgttgctgttcccagtaagccaaccagcatgaacattccaatcaccatcggcagtgtgttgttgtcttcgccggtttgcggtaaggcggacttgccggtatagccggatgacgggattcccattgggctgtcgagggtgcctgacttgccggaagttccggtggtgtcattgctgtcgagcgtaccagaggatgcatcgtcgccgtcttcgccgggtaatggtaattcgccttcatcgtcttccaaatcgttgtggtaaacgatgctgtcatcttctttagtcgccgttccggtaaccgttggactgttcacaaccgctgttcgcttggtaacagttgttacatagccatcagctgagtagtccttttcagacacttcatatttcgcaccaagcggaatgaagaacttgatggactggccatgaattaatgtgaagctgccgttaccaccgttgaattgaatggaaccttcaacaacttggccattggttgtgacctgggtcttaaacgtcccgttcagtgggttgttagccccatcggttgcttcaatgtggaattcaaacttgcgagctctgtcgcccagttcgttcacaaatttgctcacagagaggattcccagttccatttccccattcttggtgttggtaaattcaaccgtccctttttgatcttcaactaacttgaaggtttgagtggtcatcccttcttgaaccttggcgccgttcacctgataggttggtgcaaatccatcaacatattcttcgcccaccgcataagtgtaatcaatcggcaagccggtaactgtcaatgattcgctgtccttcaaggtaagcacgtcggattgaccgtcggcgaatttcacagtgatttcgtgtgagtctccgtgctggtcaaccttggtggccttgaattcgccagttacaccagagtagatgcggaagttgaagtcacggtcgtggtcgctggttgtcaaaccatcgccggcaatttccttgttaatcttcaagctggcaactttctcggtgtccttgctgttggtgaagtccacgttgacgcgatccttatcaaccagctgaaattctttggtcttaacgccgtcttccatccgggttccgttgagttggtactgcgtgtggaaaccggaaccgttggtttcagtaacagtgtaggtgttgtgttcacttggcaagccataaatcagaatattttcgtcagccttcatattgacagtggctttgccatcagtaaacgtcactttcactttgtcatgaccgtttacgagtgcgtcgtattcgccatcaacacttgcgttagcttcaatcacgaactggaaggtcttgttcttgtcagcgtcgatgatgccgccgccagcaaggtgcttgctgatcttcagctcggccgtttcggcttcaaatttggtgttggtgaaaatcacggtccccaatttaccttcctcagtcacaaactctggagcgacattgcctgacttctcggtgttttcgttgaccttgtaacttggatcgtagccttcactacttgccttggtttcagttacttggatgttggcaccaattggtaggccaaggagttgggccttttggtcatgcttgaggttgaaggcaatgatgttgttagcattaaacgaaacaggtgtgtcggtgtacttaccacttacttcgtatttgcgaagggtgaatgttccgtctaatctgccaccgttttcactggttccttcaactctaaatctaaactgcttgttgaaatcttcatccccaacggtttcgccctttactgtcttcttgacttcaatgccagtcttaagcgaatggttattgaagattaaatcagccatatccttgtcagtcgtcaattcatgagtatcaccgtcttcggtatggttaccaaatttgtggctaacttcaaatccgtgagttttagtttcttgagcttcaagcaacaagccctttgaaatatagatggtaatcccctgatcagctttcaatttgatgatttcagatttgtacacgtcattgtctttagtgaacgtaatcttgccatccgcgttgtccgccttaaattctttagtctttgcgtcaccccaatttgcgggtggattcttgatagtcaacacaaactcaaatgctttatccttgtctcccgctgctacggtgccactaaccgttttccgcaatgtgaatggaacaaggtcgggagaaatattttcgaactggattgagttcttgaagttttccctgttcagttcaatgtcagctgctttgctgtcattcttcttttcctcgccatcaacatgtgtgttggtgtcgtagtggccctcgcttagttcagtcactgtaaacttggttgcatcttttggcaatccaagaatcaccagcttttcattgtccttaagggtgatctccttaattccggttacaccatactcaatttctgttacggcaccttcatcgtcaaatgtgatatcaccactgttaataattctgtcagtagtagaatttttaacaactgctttgtatttctgccccttaatcgcattacgagtggcatcatcatttgccttcactttaaacttgaagtcaacgacgccctctggcatgtcaccagcaactgttttttcaaattcaaactggttcacaacttgtcggttaatgaatttcaacatagtattcgtagcattaattgaaccagttgccttccagccatcttcatccgaattgccggcttcattctcatccccatcgccaactttgtaatgaacttcggtatattgggtatcttgtttttcatataccttcacttttacattggctggcaattggatgttccgatagctttcaccagtcttcagcttaatcggtgccgtgctaccatctgtgtagatgatttctttggcaacaccaccggtaaatttaaacttgactggaatgtctccacctgagtgtttgattccttcaatcgtgccgttaaagctcttatccggctgattgtcttcatccaataccttcagcatgaaatcaaattccttgttcttgtcagcattggcatttggaccttggattgttttggagaatccaaaatgcgtcgtctgaacatcattggtaaactgcacgattccagctggagcattcttaccgatcatcatttggaaagtatctgtttcattaccgccatttccatcaggttcaaccgtcgttaagttgtcaagtgagtgggttgtgctgtatgaaccattggctgattcgatcacccggtacgttttgtcctgtggtaatccgtgaatggtgatcacctgaccgtctttgatctcttgaagattagttgaaaccccttctttgaagttcacaacactttcgtcaccatcaatatcgtaggtgaaatcgtcattgaagtcggtatcgacatcaccctcgtcgttgatcacatataccttaaattcaaacttatcgtctttattggtattcagtgaattggtaaccgtctttttaatcttcaaagcattagttcggtgattcttagcagtgacgcaataagtgttctcattgccgtcttcagtttcttcttgggcatctttaatggtaaattcttttgaaacccatctatcatcataattctctaggccctgagtttcgataatccggtaggtcggtttatcgtaaaggccgtcgaatgatgcgaaaccgtctttgtcggttgctttaggttcaccaacatttttccaaatactatccagatctttcatttgaagttggaatttgacgccttcaagtggagcgccagtcgtggcatcaactttcttaacgttggcagcgaaagttgtgtactgcccggcaacttctgcacttgattggatttcttctttgtcttcaaaatctttagaagcaattgtcaacttgatctcattactataggttgtcccaaccgtcttggaagtaacggtatgatactcaaccaatagcggtgttttaaccttatatgagttattcacattaatcgtcatcgtattcaaggtatcggagtaaaccacatcataatcgtggccttcaattaaggctttatccgatatcttagtgtaatgaacttccttattgaccaaggatcgttttgcttcatagattttcagcttgtagcgatcatcgttggtcttcaagtggtagtgcccaccactaagcgtatcggttagtttaactggcgatctaagttcgtagccattcccgttaattgccaaattccatttaacggctccaacggatcgggtctgcccgtcaccctcgtctaattcaaggttgtgttcgagcaacttccctgacttgtcgagtaaatgaccgccatctgcgtaagatacactcgcctttgcttcaagggtatgacgagtctcatcgtcagcattcagtttccatccggcagtgactttgttattaaatgtccaagttttgagatgttcataggtcgcttcttcatcggccttaaagttcaagacttttgattgatatttcaactcgaacacttttttaccgagtacactctcaccatcggcattctcatgatccagatagatattgttgtaagcatcttcggataactttaagttaaaagttactttatgattttcatcaacatcaacccgaacttcatattgatcatcaactaacctttgactgtcagatacgccgcgaccatcagagttaatcctagccagggagatctggagggtatcttgtaaacgttgctgaatatcttgaagattacgtttagtaagctttccagtagcgtctttgatcacatccggtccaacttcatcagtgatatcaatcccatcagtgaccaaggcggcgtgctcatttgaacccaggtattgccggtagttgaaacgcgtcgtccaattaatgaggccattgttcaggaaatccttatccaattgcccatcctttgaaatgttgtttcggatgaggcctccctgattgacgcaagtctttacacttgcgtcatcagaccctgagtattctaacccagcatagttacaaattttttcaagttgggcataattagcatttaagattttttctttgtccaatggaacatcctttagataaatattaaatgatttttcaccagccggtaaattctcaacggtgatgataatctggttaccggaaagtttgacactgaatgctttgttgtccttgttcttgccccagtatgcttctccatcgatgatcgtgtaatcccatgtttgatcattttcatgcttggaaaatgaaattcgtttcttaacttcttcagtcaaaccatctgtatctgtaaaactgttataaaacttcttataatccaagaagttgagtgtctccccttcgattggttccgtgatcttgaatgaaccatcaatttgtcgattgatttggttgacgtggatgctccatgagctcatcatcttttgccaatccaagctcacgttgttcttactgttgatttggggaccaaagtgattacccttcttttggccgttcacctcaaccgtattgctgatactctggtaatctttgtcagtcacgtctgctgttggcttaatgatgtaactaaacttatatacctttgacccttcgttttcgctgggaacaattacatcagcaaactcaaccgtcaacgtctgaccgtcaattttgggatcacctttcatccaaccggtaacggatggtattaatgtgtaatcatcaatattctcactaaacgtaaatctcttggaattcaaagtatccttcaacacaatatttgtttgaccaggatcgacggtgaattcaacggtatatttgatgctgccgtctttatccatctttgcagtcttcttcacctgaccattttcacgggtgatcgtcgccgtgacatccaacgttttggcagggtctttcacaccaacaatttcgacatccgtcgcacgaattgtatttttgaaatctcgattgttgaaattagttacgggggttatcattttcactttaatttcaattattccccgttcaagcccaagtcctttagcgttaaattggaaatttggaccggtggctaccaatttatcataatcatcatgatttttggtgatggacactgtctgcccgtcagcacctttcacttcaaactcatagctgactttatcattggcggttgcatagccgccaccgaatttatctctcagggtaaccttatttgcttctttaccgtcctgcaccttaaaggtagatgtccattcaagcatatcaagatccgttaccccattagatgtgtggaacacaccatctttttgaatagataccaaatcttcttcgactttaattggatattcacctttagtactttcaccaaaactaatttcttcggcgttcgcattgatttcggtcttgatttttgccttgtaatcaatgttagtcacaccttccaagtctccaggaaggaaaataatcttagcatgttgcgtgtcgcggtcctctgcatcacgggtcatgataaaccgaccaattgtccggcccccataggtgatgtattcgtcaaaggaacctgatggaccgtattcatacttcaatcccttaagatcaaattggtagtagtcgccatctttaatgtcaatcccggtattttccttaatgctatcaatatcccaaagataagtaatctcaatatttttatgctctcgaagaatagccggtagttgaagctcctgttcaagtacagatggcactttctgattttgagggttaccatccttgtcaatatagttaaaattgattgaggtgaagaattgagggtttgaggcagcgtggatagcatcggtaatatcagtttttccttcatcaccgaacacaccatttcccggtaattgccgagtcaattcgttacttgtcggctcctcagcatctgagtcatcgctggcaacggcttcttttgcacccttcagatcagaaacatctggtgtttgtggtgtttgagattccttgctctcaccattatctttgactgttctcggatcattttgtgtcccaacagctgcttgttcttctgccttacgattctcttcaatcgcctgacggctcttctcctcagccttcttctgatcagcctcacgcttctccttcagtaaagcttcagccttatcgctgttcgattgctttggctgctgaatgtcatcagcttgagaagagttctcattaatttcggtttctttctttggttctgcttggtcttcggtcttaacttcagcttcctttttagcctcagcctgcttagcttcttccgcctcgcgggcagcttgagcttcatcggatgccttttcgtcagccagcgcttgcttcaagatgtcatcatcttgcaggtcgccgtctggctgatcggttgtctcttcttgtttgactttttcgtcttcatcaagcaccgtcaaagttggcagcttgatcttttcatcgtccaccacaaagtccaactcgcggtcattgacagtccgattgaatttcaccggcaaaatcacctcgaggtcggtcttatcaatggcgttggtccatgaaatggttgactcttcgccatcaatgtcgacgacgactttggtgtcaccatttgaaaatttgaattgtttcttcttcactttgaaataatcagcattatagtcaaagtgcacagtgccggcctgcgatagcccacccactgtcatatcaaatgccaagttggcggagtcgccaacttttgatttcgttactaatgcacgtttatcatcaatcaatttcgcgttatcgacgacaacttccttagtcgaaatcacgtcggctaaagcggttccggcagtaaagaaattccccagaaccagcgtcaacacgccaattgcttgtatccaaaagcttgtccttttcttcattgttgtcttcctccatatgattgattacatccctctcttatcaacatcataaggatacctgaataatatgcgtaattttggaagaaattatgaagattccgtatcttttatatccggtggcaggcgtgggatttggaagatggtcgtgaaacggcatggcgttaagtattccggagaatgacattgttttcccattgattattcaatgaatccgaatagaatgattaccgatcaaatcttagtcataaaaagttccaaagctaaagttttcgctttaactttggaacttttatgtcgacaagtggttagccatttttgttgtagtagtaattactaggtgttactatatatttaataaaaaaggaggggattagtttgaaagcacgtaagcagggtaacactctggttttaagtattcccaagcagttcaaagtcgctgagggaactgaatttatgagtatgcaggcagctgatggcagcctcatctatacaccaaaagccccaaatatttaccaagatcccaaatatgctacgactgatcttagatttatccccaaggatactaacgaccaaccagtcggtcgggaggaaatctgatgtcaaatcacccaattacccattatgattatcatggttacactcctaagcaaggggatctggtttacattaattttgatccaagtattggtcgcgaaattaagaaacgtcgtccagccattgtagttagcagtgacgcttttaactcgcggactggttttgtaaccatctgtcctattaccagtactattagagacttaccatttttcatcaatttacacggtaacaaattacacggtcaaatcaatgcatcacaactgcgaacaattgatttcatggccaaagaacgccatattgaatttgtagaacgagccgccagcacagactttatgcaaactgccaaaatcattatggatgggcttggttttgagagcatcattaataatctttaacacattctatttcaattcgagcagcttaaataactttaaaacgggtttttaagggggaattccaatgtgtggacgttacatgtttgagccaaaacgtagccgtgaaatcgcgcggatctatgagctggcaacccaagctggctatgagccaacaacgggtgaagtcttcccatctgatcaaacggcgctggtcattgcccagcagcagaaaattcaagttgtggcgatgaagtggggattcccaggctttcacaaagggcaactcattatcaatgctcgatcagagtcggtcactgaaaagaaaatgtttgccaagtccttccaagcccgccgatgcgtttatccaaccagtggcttttttgaatggacaccagacaagcaaaagtattggttcaactacaaagaccaacccgaacccttatacattggcggtttctacaatatctttgaaggcacaccccaaagtattttgatgaccactgaacccaatgattccgtcagtgtcattcataatcgaatgccattgattttgaagaagtcggagattagagcttggttgatggatgatgaatttgcgaatcgctttttgactcggcagatgccgatgttgatgcgacagaaggttacttcggaataaacagcttcatttttttgaaattggcgtcgtgtattgactgcaagcaattcagctatgttataaaaaggtcctgccaattttattagcaagacctacttaacattattattgtgcggtataaccgccatctaccagaaattcgctgccggtagaataagatgattcatcagaagctaaatataaaatcaaatttgcaacttctgcagtttcaccaaagcgccccaatggaagcattggcaaatgctcgctaactaacttctgctctttaggatcattatctttttcaggcttatggattggccccggatgaactgaattcacacgaatattgtacttttgctgagcacaatataatgccgctgatttcgtcatcaaccggaccccaccttttgctgcagtgaaggcaaataaattcggatagccaattaagccttcaatagaggacatattaataatcgaaccaccattagttttcatattttgaatggcatgcttgattccaaatgcaactccgtctaaatcaacggccataatctgatgccattgctcagcagtgaaatgttccgcatcccccattgccgcaattccggcattattaaacaaaatatcaacttttccaaacacgtcaataaccttttcaaataccatggcccaatcagcttccttagaaacatcttgttggataaagatcgccccattgccaattttcttcagggctgtttcccgattggtatcgttaacatcagtaataacaacttttgccccttctgtagcaaaccgagtggctgtggctagcccaattccgttcgcgcctccagtgataactgcaactttattacttaaacgtcccataatgataatctcctttcagaacatgattaatgacctagaaatgttgctaaatcgtaagatataatgactgtgaattaaatcggaaagtatggtgaatccgcgatgaacttaaccagtttgcgatattttatcgaatcagctaaatacttgaattttacaaaagcagcggaacatctttatgtgacacaacccacactcagcagacaaataatggatcttgaagcagagcttggcgtccagttgtttgttcgtggaagacacacgctaactctgactagcgaaggcgatgcgctactggaacaagccattgatattgtgacgaaatttgataatatcaagaaaaccatccagccacatactaatgaattaaccggcaagctcacaatcggatatcaaagtttctttgatactacgctcatgtacgatgtcttaaagtcagtaactaagaaatatccaagagtcaccctgtcactttttcgtggtacgccacttcagttaagacgccagttaatcaataatcagtgtgatgctatctttggcttaaatacttacatagatagcattccaaatatcaagacaattgaacttcaaaaaaacaagttgcaaattgcggtacccagtacacatccactagccaacatgaaatctgttgatattaagcgattggcaaatgataatttcattatgctcaatcgcaagatctcaccattcattgttgactacgcgatcagtctttgcatgaaaaatggtttctcacctcacgcgttgtattacgtaaatgatgctgagcaggcattgcttcacgtgggttctggacaaggggttaccttcctacactcaatgaataaggtgaacaacccagttgaaagttacggcgtcaacctgcttgatattaatggtctggataatgatttgaacttcgttttaggttacaaagaaactaataccaatccaattacggaaatttttgtcagagaattaatgaaagttcaccagcaaaaagatggcagcaattaacagaaaagcttaaaggcgagaagtctttaagcttttttgcatcaatcacttcgcttcaacgtcttcaagttcaaaaccaactgatttgaatccaccgtttaactgaataaggtgcaccttagcctttaatggcaatttagtgatcaaatcatctttattttcttcagtgacaccatatagggccgcatggaattgatgagaaccatttggccaatgtccgactgatacacaataaggatccttttcagtgaaaaattcatcggcttttctaaatgtgtaatcgccacccacactagagtcctcaaagcgaatttcatcgattatggcctcatcgcccatctcgatccagtccaggttatagctgccgcaatcttggcaagttgggagcggaggccagaccactttgccacaatcctggcacttcatccctaacaccttgccgtcttcgagactgtcataataggtttttaaaattggacgtaatagatacatattactcactcctcaattttgatcttccaaaataataccaactgttgtatggccgccacccatacctcgtacaaggcacttattaacaggcttgggaacttgcgagccaccagcttcaccgcgcatctgtaaaattgcttctccgagcatacatactccagcacacccaaaaccatgcccaaagctaatatcgcctccatgagggttaattggtttctcagcatcaaatcgcgtcttaccttccaactcatacttgtagccttcaccctcaggtagatacccgaacacttcggcactatccagttgttcaccagaggtcataacagtggtaatcatcaaatcaaagtcgctccctttaattccagggtgcttcttgtaaagattgtctctgacatcaacgttcatttgatggaagttaaaaggatacctagttgtgtttgagacagttgcatcgtcaatcacttgaatagggtgatctgaatatttcttagcaatgtcagcagagcacacaacaatcgctccggcttccatgttatggagaacactgccgctcttgcgaatatattgagtgattttaggattatgttctgatctcatatattccaatggatcgtcgtagccggccttcttagcgatgtcctcatatctttcatgcatcaaggcacgaggattgtgtgaggcattatatcgaagattcattgccattgagttataagtgtcatccagttcatcctcggtaattccatagtgtttaatgtaatatttgccttgttcttcagtaagcaaattatcactgacaccatcaaaacgcgtgtaggcagtatcaaacaatacccgacctggtgaccaccaaccattgtcatactctttaataggttttaatttatatgctggttgatttcgagaattgaaatgtttaggattctctaatccggcaactaaaacaatgtcatattgtcccgatgcaacactatttacagcttcagtaaaggcaatatatccgccagcacaggcctgctcgatatgcgtgattggtttacctgccaaccctgcccactcctctaagctgccgaccggagccatcacaccacccatggtgatgaagttagcgaactgggaataaaccactttgtcaatatcttttggtttaacatgcgcatcatccattgcttgatgacaagcatctgcccatagttcataaggcgaaagaccagccattttaggatcgtcaaaacttcgttgaggaagactacttgtcccgataaccgataccggtcgtgcaaattgttgtttcatcatgatttcctcttttctttaaatatgtggtgatagttaaaatgtttgcgcttacatttttggatggaaatatcattcaaagttttttagtaccatatccctttgacacttaaatcatatcttgaatgcaaacccctgtacaattggacttttacgaattaacgtaggcccatgttaaggtattcacaaaacgtataccattattctgtcacccttctttataattcaatggattgaagtcaatatttgagacagatttgaagggaattggacccatttcaaccctataagaagccataataaaagccctgtgaattgaattacaacgcttcaattcacagggttagctcatttataatgatgttctgacttccgttaagatcaacagccaactggaccggatcctgtgatcaaaacattgaatgtccactcacaagaacctattcactcttatcaaaactactcatcaaaaagtcagtcaactgctcctcatcaaccgtctcaatcccagccttcttaaccgcacgcttaacattccaccgactaggtttcttcccacttaaggcggcttcgatggcgttcagatcgccatcaaccttgaagaacgggttgaacttcagatgggaaagcttgccgtcgtcaatcgtccagttgattcccagcttgccctgatcaaattcagtatcagcgtaatcgtaatagccaggattatggccaaagttccaggcgtcggtcccataggtttctgccaggcgtttgtcagcaacttcccaatcctgatcagtcatatggtaggtttcaatgtcatccagggatttgacttcaaagatttctttgagcaggtattcgcggaaatcagccatcgtcatcccatccggaagaaagtccttcaggttaacaattgggctgcgcttggagcggactcccaagcccttttggatttccatctggtcttcagtgaggacttttctggcattttcaatgttcaaatcatacataatcgttccgccggccgccaagccttggccgcttttaaacatggtcatgccagaccacttcttaccgtccaaaatgaggtcactggaattctccctcattttgacgtcgatgtttaatttacgaagcgctttcaaaactggttctgcaaaatgcccataatcaccaaagtcgtcggcgttatccgtcaaaatgttttcaaagatgaagttccccatatcgtgatagacagccccgccgccagacgttcgccggaccaactcaatgtcgtgctcgtgcagatagtcgatatcgacttcagcccacacgttttgatttcggccaataatcaccgatggcttgttaatatagaacataaatccgtgtccaggaagtttgagatcattcacaaaataattgtccaatgattggttcacccgcgcgtcatagctgggcttgccattcctggaaatatcgattaggtacatctgacattccccctttgttcaaattctcgtacatctctaattatacggtataattgaggtaaataatatcgaggcggtgtcgttatggcaaaaatttcaatttggcaaaaaatcatcaatttctttactggcaaaaagcagtctgctcaggctccggcccaggttaaagatggaatctggtatcgaaaagaagctgacggtaactatctattgggcatcgacaaatcggtctatgatttgatgggtaagattactttcgctgattttcccaaccagttagacacgattgaagtcgatgacgatctgttggacatcgaaggtgacaaatcggtggaaacattgaaatcaccaatttcgggtcggattgtggcccggaacaaagaaatcggcaaagatattgaaaccctcaacaagcccgacccacaggtaaattggattgtaaaagttcagccggcagcttaatcatgcaaataaatcgaacaaattttgagccactttctcaaaaagaactataatgaagttagatcaaatagaaggaggtaattatttatggctgaagaaccaggtgcagaatctccattattgaacaaaatgatgtctgaggcattcgactggagcgatcaaaaattaccagtccgtgatgctatttgggactattacatggagaaaaacgaccacgacactctcaagactgaaaaagatgttgaaccttacatgaacatgtcaactgatgatcttaagagcaaagctgaggcattactcaagaagtaatttttcagtggttaatcaaatacccgcactagtttcgtgctaggcattcaaatgatcttcaagcttttggcttggaggtcatttttttagccacatcaaatttacgatttgagttatgatgggattaattaataaacgaggatggtaaatgatgaaaactgtgacaatctcagatgtggcaaaggccgctggtgtttcggtgacgacggtctccagatacctcaatggaaactttgccaaaatgagcaccaaaactcaagctaaaattgaaaccgtcattcaccggttaaattaccacccttcagcatcggccaggcgcctcaggaccaatcagtccaaggtcattggtgtcatcgtcggtgacatttccaacgtcttctcgtcactactcttcagtggcatctcagaggtcctccatccctacgattacagcgtattgcttttaaatgccaacaactcagccgacgatgagcaaaaggggattaaccgcctaatggagcagcgggtcgatggtttcatcattcaaccaagccaaacgacgatcgatgactatcagatgctgctgaaagaaaaagtcccactgatcaccgtcgaccgtgacttgggaaatgtgccagccagtgtcggtaaagtcatgaccaacaacttggccgccagtcagcaatttggcaccgaattgattgccgcggggtatcgccaaatcctgctaatcagcagcacgaccgtttcaatttctgcccaggccccgcgggtggttgggtttaaggctgccatcgacggcacccaaacgacagttacagaaattaacattgccggccacccagacaactggttgactgaacagattcaagaaaaagttgccaatttctcgggcaaaaccgtgattgtctcattgatggggccattattattcaaaaccctggcttcattgagatcccttaagttggccttcccagatcaagttggcctggccagctttgatgactggaattggtcgcaatttgtcggtgacgggattgatttgatggaacaggatcctaaagaaatcggccgtagtgcagccgccatgcttctgcaatcaattaaagatccggctttggtcctgaaaacaaaattagttccggcaatcagagtcgccggccattcattttaagttcagaacttaactatttgtcagttatgtcttggtctctcttgaccactgctatcgtgcttaagcatgcggcaatcggctgagccaagtcattaagcaaacaaacgagtcattcctaattttggaatgactcgtttgtttgcttaagttctgggatcgaaacacctcactcttttgttcgctacataaacatcgaaaccgctaagactgataacaggccggtcacagataacaccgacgtcagagtcgtccacgataagaaggtttctttcagtgtcaaaccaaagtattccttaatcatccagaagccagcgtcgttaacgtggtcagcgaacacggaaccggcaccgaccgctaacaccatcaatactgggctggccccagacgaagcaactaagggcgctaccagtccggctgcggtcagtgaggcaacggttgccgaccccaggctgacacgcagtaacgcggcaacaatccacgccgcaatcagtggtgacatattcatattggtgaagatgtcggaaatatatttggcaattccaccatccatcaaaacctgtttaaaagcgccaccaccaccgataatcagcagcatcatcgcaatctgtttaatggccgtgaccatcgattcactaatttcctgcatctttttatttcgggccaatcccatcgtgtaaatggcaaataccagggaaatgagcatggcggcgtccggtgcaccgagaaattgaatgccttcgttgattggattggttgccgggaggatgaatgacataatcgttgccaaggcaatcaagatgaccggcatcatggaagttaaagcactgatgccaaacccaggggtgtcttcaatctcaaattctttgaactttcctaaagtgctgatgtcaatatttcgtcggtagacctttggatagactttgtgcaaaaacatgttaaacaaaggcccagcgacaataatcgttggaattgaaacgacaattccaatcaagaggacttgccccagaggtgcgtgaagaattccggaaatggcagttggagctggatgtggcggcagaaaagcgtgtgttacgttcagcgtcgcagccatcggaattcctaaatacatcagcggcaagtcaagttctctggcgatcgcgaagataattggcagtaaaacaaccaagccaacttcaaagaataatgccaaaccaacgatgaaagctgccagaacaacggcaatctggatgtggcgcttgccaaatttctcaatcaaggtgtgggcaattcgataacccccaccggaatcagaaaccaatttaccaagcatcgaaccaaacccaaagataattgccaaatgtcccagttgaccgccaattccagtttcaatactcagaggaatcttggcaacggggatctgcagcatcagggcaacaataaacgacgtaatgaccaacgacaggaatgtgttgagcttgaccactgtgattaagaagactaacagggcaaccccaatcgcaacaattaataatggcataatacatgcgtcctttcagatagtgcctgtccaactgaattcaaatcgattaatttctttaggtacgctattgaatttaatttatctgagcaaataacccccatccaccggcagcatgactccggtcacataatcagatgcctggctggccaaaaagaccattgggcccatcaattcttcaggaacgccccactcacctgatggaatatgttccttaatttctggaccgcgaaccggatcgtcttggagggccttggtcatgttggttttgatataccctggagcaagcccattaacctgaatgttgtagggtgccaatgcatccgcatatgctttggttaagcctaaaacggcgtgtttactggcggtgtacgggaaaataaatttgccggcccgataagactgcatcgatccaatgttgataatcttgccgctcttttgcttggtcatcaccttagcagcttcatgagacagatagtaaagggcatttaaattcaaattgatgaccttctgccagtcagcatcctcaaatgccagcacgtcattacgaatctgcatcccggcattattaaccaaaatatccaagtggccaaattgatcgatgacactttggacaatcttttccgccgcaccgacttccgtaatatccattttcaaaaagccggcttgttgaccattgtcggtgataatctggcggatctcgtcccaaccattttgcgtccggctgacgatgaagatatcagccccatacattgacagggcaattgaataattgcggcccaacccctctgcaccaccggtaattaaggcaaccttacctttaagtgaaaaactgtctttgtcaaaatttgtcatagtcatacgtcctttcaatgcttgttgacttaggtgtatcgatacaccatttgaggataatataaccgatttaaattaatttagcaagcgcttacactccttcccgcaaaaaaagaagctgaatgatcagcttcccgtttgtctgcacttatagggtcattcccaactacagtatcggaaccacctgtttggcataatgaaacaccaaaacccgcttaaccgcaaattcgttcaccatgtatgacttaaacaggttactcaagtagtttcggttgtagtcgtacttcgcagctaatttttcaagagaggtatccttataattaccgttaatttctttgagcatttggacagcaatctcctgagattttgacattggcttattcatatctactttgtagttacgtaccagctgagcaatcaaaatcgaaagataggagctgatgatggtatcggcaaagtctcgctgtaaatagtattcctcaatgattcgatccaaggtctcttgaacctcgctctcatcttcgtgcccaaagaccaagtaatgaatcggactgtcatcgccgattcgccgattcaataaaaattcgtacaaaacgcttttactacttcgcaggtcgcttaacaaatccaggttgatttccttgtcgcggaacaagacattaattaataggtcattggttcctagataaccaactgaatgtttgcaaccaacatcaaggagtaaaacatccccctgctccaagtgaatctgttgtccctcaacaacctcatcacaagaacctcggagcatatagttaatttccaaaaaagtatgagcatgagttgggtacggcgcataccgattatgcttactcacgtaaatgctcttattcttgaacaaagcatcactgatgatcggcgttttttcctgttcagataaggttgtatcatagacatctattggcagatcattatgaaattccaggcttttcaattgttctttttccagcttcgtcggcttcatgagtgtatttagaatggtatcaagcatattattcgttccccttcaggtgatattgctatcctatgataacgcattcaaaagaattaacatattgatattgtcaacgaacctctttcttatgtaagaagaaaatcgacatttattatataagtatcatatatacagcccggtctattaattatctgttttgaaaaggcaattgcaaaacgtgtcactttaattatgtatcatttgtacatctgtatttgaaaacaacattttttaatataatctattaaaaataacaaatgtttctcttgtctacatattggacgtgctattcaagccagtttttgaggatagctcctacagccctgactcccagctttactgttatctagcggaaacgtgcgcctgcagcccaacccctaacgtataagaaaagaaggccaacaatgaacgagttcatcattgaccttcttctcttatacacctgtatcttcactattacctagcggaaacgtgctattcaagccagctttctccgcttaaccaaataacgggtagtaatgtgcacaacccgcacattactacccgttattccgttaatgctttaatactgaattacctcagcctttgaggacagctcctacagccctgacccctaccgtgtaacacaaaaaagccaacgatggacaaagaacgtccatcattggcttttccgcgttacactccggggtcaacccgggcttagtcgctcacttattttttcatatccatcgcatggccaccgaatccgtgacgcaatgctgatacgactttacctgtgaatgtatcttgttccattgaacggttacgggcgaataatgcgtccgtgataactggaactgggatgccttgcttgagggcttcttgaacagtccacttaccttcacctgatgagaacatcttgccgctgatttggtccaagttagcatcgttagcgaatgcttcttgtgccaattccatgagccagccacggataactgatccgttaacccaaactttggcaacggcttcgttgtcatagtcatatgggctgtggtccaagacatcgtatccttcaccgatggcttccatcataccgtattcgataccgttatgaaccatcttcaagtagtgacctgaacctggcttgccagtgtaaaggtagccgtctttttgtgaaataccgtcaaataatggcttgatgtgctcgaaggcttcggcactggtaccaccgatcatgaagttaccaccgttgagggcaccgttcttaccgcctgaagtaccacagtcgaagaagttaatgtctttgtcttcggcaatcttaccgtgacgaattgaatcttgatagaatgagttaccaccatcgatcaggtagtcgccctttgaaagaaggccaaccagttcagtaacagttgagtcagttggcttgcctgctggaaccatgatccaaacagtgcgtggtgcgtccaacttgctgacaaggtcagcgttgcttgatgcaggagttgcgcctgcttcttgagccaatttgatgtttgcttcgtccaaatcaaatgcaacaacttcgttaccgttacggatcatgttcttaaccaggttaagacccatttttccgagaccaatcataccaatttgcataagtattgtacctctttcgtcttatatattagttagttacttgtctacgatgcttattatatattttgaaaagaattttcgcaagcattattgataattattttcaaaaagtgcgatattctttgaaaatatcatgaaagccctttctaaatgccgacatgttggggttctatatgaaaatcatttttaacccggatgcccgttgaataacctcattgttgaaaatgctttacatatttgatttcaaccgccgccagatggcagtcccagtcagccccagcagtccgacaatcgtcagcaatgctccggctagtagtcctctgatgtgatagttaaaggcaatttggtgcctaccaggcgtcacacggacacccaccaagccgccagcaacctttttaatcggccgctggtgcccatcaactttggcctgccaacctttatcaaatggaatggtcaacaccagtgtttgagctcgtttgccaaccgttacatgccccttgaaatgcgcaccatgttcattgagctggcttgggttttgcaatttaaatttatggttgtcctgatagttttcaacctgcctgagtttggcgagatcgattccgcccagatcgccggcaacgtgatgcagttccttggttgaatgaatcgtcagggttgaaatttgacccttttgcatatatcccatcggaatcatttccgtccccaagccactatacaactgagaaagtttttggccattgatatagaacgacacgtttatcaatctgacccgtggaatgtataaataatgcggtccggtggtgttagcccagaacttgactttatattcaaaatagtcgcgatgaacgaacttggcactgctaatggttgttggcgcgtacacatactgacgttggttccccgccgttgcttgaacaaaatcattcaagttgtcaaaggcttggccccgtttcaacttgaggtcttcaatctgtcggttggccataaatcccagcccagacgttcgttttctaaccgttaaatgattcccataacgtcccaggacatcataatacttcagaccaaagaaatagttggtaatcgccgttccgcccagcatatcaatccggcgaatgttgcgggtcgaaaatcccaagtcgcctaaaacatggtgagtgtgggcattcaaagtggaactatacgaactgatgccatgatttcggtataggaatgaatcgttatacccgctatagggcaccttgaacaaatctcggaacggtttatcaataatcaagaaacgatagaagccatcatctgattgatatcgcttttcaacgctcccgattaatctggtggattgcgcgtaagtccgttcaaaagccttttggttgccaagtggggcttcatcggtggcaatcataaagttcaagctcaactcaaatgccaagacgacacccaaaaagattcgactggtccaccgctgcctgccaacgccaatcatggcaatcgtcgtcagaaaaatcaggccgaccacgaaggcaaagatgatgttgcggacagaaagttggggaatatcaaaacgaaattccattaatttttgcccttcaatattggcaaaaatatacccaatcaaaatcgctgctccaaggccgaccgccgaacgaatcaacaacttctcttcggcaaacatcccctgcagataaccctcataggtcaccatgatgatcgcaaagctgaacagaaagaccattctaaacggaaacccagccggctgctgcatcatgtgccaaatggtatttaacggtaaaaaccacatcccaacaaagataccgccaatcaagataccggcagcctgcttatcgcgctgactaaccagcttggtgaagaagtagacaatcgctccgatgataaacaacgagccggtgaagaaactgggattatgtaccagccggccggcgaaatcattgccaccgacgccgagattgaccggaaaactgaggccaaacgttcctttgaacagaaagttggcggccagtaagtccttcttcccagtagccatcatcgcgatggcagtggggatcagaatcacggcaacactcatcccagctaacaatgaataccaaataaaccaactaatcttttgccaattggccttcaggttttggaaaaatggcaatgaatagggttgattctttttaagtaagtaggccatatacagaacattgaagatgcagatgatgtatcccatgtagaagttggtgaaaataatcatgatcaaactaacaacatatagcgcagggttcccgtgataatagagtttttccaatccatagaccatcaccggcagccagatcaaggcatccagccacatcagatcataaaagtacatggccacaaaaccgcacaagccgtatgccaggccgccatagactgccatcaagtcatagttttgatattttttagccaagaaaacactcatggaaatggaacacaaaatcaatttgatccaaataatcaaatcaatggcgatcggcagctgagccgttccaaacagcatgatgattaaattaagtgggctcaacaaatagtaagcatagattggcaccaagctgtcgccaatcgacatcaaaaaggaatacccagagaagctgaagtgggccagctggtgctttaattcagcgaagaactgcaggtattgcgtcgacaggtcactgaccagtagattgtggctgccaaacggggcaattccaatcaccacaaataaggcactgaccaacaaaattggaatcagcaccgccaaaatataaaacgatcgttttgtctgacgaccacgttgtgacagcatatccgtccacctcaaatttgattttcgatgcgccgaaaatcgatttcgaacttgaattcagttccaattataactgtttgcttggataaatctttcattagagggattgattttaggaactattaaaaaacgtcaatcttttgttacacttgacccccttaacctgtaacaaagcagccgattgcactgaatttgtcctgtaatgcgggcaaattgacaaatatatccaataaattagccgcttttttcaaattagattaccgtaaccattgccgtcaccacgcgactcacacaaatacgaagaaagtgtgaaatttttcttaacatttatgaaacaatcctgatactggttggtagcattcatttcatataattgttcttgtaagtttttagaggaggactattcatgacattgaaatttaaaaaaatagccggcctattaatgggtgccctggcagcatttacttttgcgacaaacgcatcagctgccaagacaaaaattgctgatgtttctcagtatcaaggaagcatcaactggagcaaagcctccaagcaattaaaatttgcgatcatccgggtccaacacggtgacaccggcgatgcagatttcagaatcgatactcaaaaagatatcaacgctaacggcgcatataaatataaagtaccatttggtcaatatggttacgcagagttcagcagcgtggccgatgccaaaaaagaagccaaggacttttacaagcgatcaagttccaaagcacgtttctacgttttggacaacgaacatcgaaaaggtaagggttcggaacaatcctacgtcaacgcttggctggcacagatgagaaagttaaccaataagcctttggtttactactcatatcaaaactacgtcaacgttcacaaaatcaactattccaagtttgatggatcatggattgcaaattattccgctaagccaaacgtttcaaccgacctttggcaatacacttcaaagggaagcttaagcggaatcagcggcaacgttgatttgagcaaggtcgtcgacagctcaactgttaattcctggctcaagacttcatcagccgatgcggctaagccaacctacttcacatcactaccaagtgataaagaagtcacagcttccaaaaacatctatcaatatcacgatgctaatttcaaaactcgggtttcaaagattactgctggcaagaagctttcagttaaatcaatcactcgttcaaacggcggcgcttatcgcttccaactcactaatggaaattacatcacagctaataaagcatacgtaactgactaatttaactaaacgacgaaatataaaggagtactcatcttgtcacacagtattattaaatcagctttaaaaccattattgttgctcgcagccttattcgcattcgctgtatctgcttatacttcagctaatacagccagtgcaagctcttcagaccaatcatattcaaaggtcttgaaggttgccaagaaacatctcggtgccagctatgtttacggtgcagttggtcctactcactttgattgctcaggtttcaccaagtacgtttataagcactcaattcagaagtcaattccaagaactgcccaagcacaatacaacggtaccaagaaagtttcaaagagcaacatcaaaaaaggtgatttagtatacttcggcggcagcaagcacagcatctcacacgttggtatgtacattggtaacggtaagatgatcgattcacaaaaccgcggtgtgattactgaaaaagtttactcaccctggtggcatgtggttggcttttcacgcccagctactttgagttacgatgactaatctatttatatcaatcgttagataggaaaacggatgtccgggtgggcatccgtttttttagtttgtggtgtttggttgtgattgatgcttgaaagtaatttgcttttctatagtgaaaacgtgctcccagagccagctttctccgcttagtccgataacggcagtcaacgcaaaacgagcgttgactgccgttatcacactaatgctcaaaagctaaccggctcttgtcgcactcttagaagctgaatttgtcaaccacttcaaaagtaacattctcattagccttaagtaatttcgcaactgggcaggtatccagtgcttcgtcgaccatttgttgtgcctgttcgttatctaattcatggaacagaatttgacagcgcaccacaaatttataaccggtagtatccttcaagttatcgactgcagtatgaataactgtatccggtttgagattatgtccccgctccactaaaccgatggttgcgttaaagcaggtactcaacgcaaagccgataaattgctcagggttggttcctggactgttaatcaatgaactgcttacgccaagagctaatccttcgttgccccggacgaaactttcaccaactaatccatgttcattaacaacttcagtatgataaagtgatccgtcaacagccatatataattcctcctatttaacaaatccaatccttcatccaacaacttaatgatatgtgatttaaatcggtaagtccatccaacagcacttacaattgttaacgcttactatagtaattatttccccattcaggtcacttttttgatacactggacgttggcgcaaaaattcgaatgaaagaaggtcaactacatgcccgcaaaagaaatgaatttaaaatggctgatcattggggccatgttcagtagtgtcgggatgagctttgtctggccgttaaccagtgtgtacctgcacgatcggcttggtgtttcactcaccctgatcggagttgtcctgttgtttaactcccttgccagtgtgcttggcagttaccttggcgggtacctatatgaccgcaagaacccctatcatctactgattggtggcgttgccgcaaccacgctgactttgattctgctggtctttttccatggttggccggcatttggaatcatcctatttttcaacgggatttccggtggctggaacgtggccgtggtcaactccattggaaccagtattcaatctcaagatagccgctatgtttttaacatgctatacttcgcccagaatttgggaatcgttatcgggacctctttggtcggcttcatctacagcatcagtgtaactttgatgttcgttgtcgccacggctttgttcgtcgttttcctgctcatcgttctggtcaaattcaaaccggctgccaacaaatcacgtaaaaaagtttccgacaccgaaaagaccacttggagctccaaaaatttgccaaagcccaatgccattatgctgtttgcttttttcctgtcattattcattatttggatcatgtaccagcaatgggtctccaacctgtcggtctatatgaccggtatcggcatcccgctgcgcaactacagcttcctgtggacgatcaacggtggcgtgattgtcatcagtcaaatcatcatcaattggatttcccgctaccatgaaaacatgatttttgaagtctttctcggcgttttcttgatgtcgatgtcgtttgtcgtgctgatttttgccaaaacctaccccttcttcgtgctggcaatggtcactttgacaattggcgaagcgactgccctgccgactattccagcgttggttaacacgctgaccccggttgaggccaaaggacgttaccagggactgattcaatcctgggcctccgcaggccgggcgttggggccgctgttcggtggtttgataattgagatgtcttcgtacaccgccctgtttatcatcgccaccagcgccgttttattagtcctgatggggttaattgtcttgtggaacaccctgcaccgaaatctggtcatgtatcgatgagttttgaccaataatctggatgtataaaaaagagcttgctgacaatatcttgtcgcaagctttttttgatgcaaatttttaattacttttacccagttggctatgacgaatcccataactgaagtaaagaaccagcccaaaggcgaaccagatgccagaagcaatccacgtctcagcctgcaattgtgacagcatcagcatgcacaacagaccggaaacgattggcaatactgggtaccatggcacttggtagccatggtggttttgaatttctttgttccgtcgtaatggaataatcccaaatgaaacgaacagaaaggcaatcaacgtcccaatgttaaccaggttggttagttgctccagcggcacgaaaccgcccatgaaggcaatgatgattgtaatggtaatcatactatttctgggactgccctttttatcaagcttgcccaggaattttggcaggagaccatcgcggccgatggaataaatcaaccgtgatgaactgtagatcatcgtgaccatcatggtgaacattccagctagggcaccaagggaaataatcccggcaacccagttcaaatgaacaaattgcaaggcaaaagcaaccggatcagaaacgtttaacttggtgtaagaaaccatcccggtcaaaacgattgacaccccgacataaaggatcgttgcaacaatcaatgtcccaataattccaatcggcatgttcttcttagggttcttcacttcagctgcggaactggaaaccgcgtcaaaaccaaggtaggcaaagaagacggcagcggctccgccaagcacaccaccgtgggcactatgccagccaaatggtaaaaatggatgccaatttgatggcttaatgtagaataggccaactacgatgaataacaggataataccaattttaacaaccacgatgatgttgttgagccgaaccgatgaacgcatcccttggttcaacatccacgaaatcagcaccacaatgatgatggcaatcagattcccatacgtcccctgacttgggacgaacggcccggagatcgcttttggaaagccgatgtgaaagcctgccaaaaacgactggaagtaggcgccccaagcactggaaaccgcagctacggctaagacatactccagaattaacgcccagccgaggatccagccaatgatttcaccaaagaccagattcccgtaagaataggcacttccggcaaccggcagggccgaagcaaattctgcgtaacacatggcggcagttgaacagacaattgcagcaacgatgaatgaaataataataccaggaccggctttggttgcggcaaccgtcccgggaagaataaaaataccagtaccaatcacggcaccaatccccagggcaatcagatcaaaggctgacatagtcttaatgaatttcttgtcagtctcaagataacgatctaattgctctcggcgaaaaatacgagctaataatgacataaacgtgcctccacagttaaatgaattcttgattaaaatacttattctattttaacttttcaacctgtataaagtcaatttcattcccttgatgtaaccgatttatcgaaaaataattgcatatttaatcgaagtcgccaaagaaccattcactgcgaaattattgtatccttgtattaaagagacttcgaggggggacgaatttgaaaaagaatcggctggaagcattcactgacgccattgtcccgattatcatgaccgttctggtcttggaattaaatccaccagaaaagctcagctggcatggattctggggaattcgcgaagagctgatgtcctatgcgatttcattcttcttactggcaatcgtctgggggaaccatcatcacatgttcttactggtcaaatcaattgacggctttgtgatctggtcaaacaccgttttactatttttcttatcgtttgtgccgtttacgactgcaattgttgacaatgatcccaacagcctgtttggctcccaactttacacgctgttattcatctgtattaatctttcgtggaacctgctgcgagtgagtttggtgcgggccaacaagtcagtcaagccgctggtcgcatcgcttaaacgagatccaaaaagtatttacacgctggtcgcattcatcgcggtctttctcatctcattttactggcacgagtttgggatgatcgggacatttatcgtcatgttgctttgggtgatgccttatcggaagattgaggatgccgctaagcggatttgaacttgaatgtgctcggtgactatttaaaacacagaaagagccaaggtaacgctgcttgttagcgataccttggcccttttttacacctcaaagctacctatccgaattgtggaataacaagcagcttccagagtataagcgcttgttattccaaactctgctttgttagatccttcaattcaatattactatccataatcccactctcaccactcaaaacaacttgattgttcttgtagtcgagtttcatatcttcatcgaggtaaatcttgctgtaacccttgaagtaccagtcgccggtattggctgataattttgcgtcataatccggtaccttggcgtcctggtcaacggcaatcacgtcatagctggtgtccaacgagcaaacgccaactttcgagaatggcccgacgccatcgtcaaagctgagcaacagcttgctattggcaggaaagactttcttgagttgtgttaatgctgcatctgtaattgttaatttcattttctcacctctcttccttatcctaaacttctgagccggaaagtcaattagattgtacacaatccttttgatttttcatcaacttcattacctgttatgatattgtcgaggtgattaaatgacaaatcaaatgaacgccgtcgtgattaacgattacggcgatcgagatcaactaactgaaaccaaaatgccaattcctaacattaatgatgatcaactcttagtaaaagttgtcagtatcggggtcaatccgattgactggaaaactcgtaaaggcctgaggaaagcacgctacccatttgattttcccattattttgggacaagaaatggctggtgtcgtctcaaaaatcggtgccaaggtgacgggtttcaaagtcggtgatgccgtgatcggctatggtacgcccagcaaccgcggaacctatgcggagttttatgcgattgacgcggatcaagccgcccacaaaccgattaccgtctcctttcaagaagctgctgggctgggacttgccggcacaactgcttggcaggctttatttgatgccgggcacctcaaagttggccaaactgtcttaatactggccggctcaggcggtgtcggttccatggcaattcaactcgccaaacacatcggcgctcacgtcatcacgaccacgagcgctgccaacgacaattatgttagaggacttggcgctgataaagtcattgattacaaaacacaggattttgccaaagtctcaccagaagttgatttagtctttgacacattaggcggtcaaaaccaactagatgctttcaaagtcgtcaagcctggtgggcgcatcatttcgattgttgaaaccactgatcaggcagaagaactcagtcaaaaatatggtgtgtcatttgaaaaaatcaacgcccatcccgataaagacgtgatcaccactctaagcaataagctcggcgccggcaaactcaaagtatcgattgcgactcagctcaagttcaatgccgagaatgtccgcgaaatgcataaactcagtgaaacagggcatatagttggaaaattaatcttgaatgtttagtcccaatcagtgcgaagtcaaaacgatcaagccatcagtataaacaattgatgttttgccgatttgttcataaaaattagcaaaaaaagaaggtcaaccggatttctccagtcgaccttctttattacggcacctaccaaagtagatggacttcttggattccacaatccgctaaagtcaaacaccagcaaatctgtgccttaaattgtgtcccgctcgaattcacattaatcgcttgcgcaacagcataaatgctgtgtgatttctcgactcatcgcatacaagtattatgccacgtttccatgaaaacatcaaggcatctttcattggcctacttttcttcaggctgcttttcaaggttttctttgaccatatccaaatgctcagccacccagttgttcatctgatccaagtagttggcgacgttgcccacgtagtcatcggcactggcgacctcatcaatccgcaaactggatttattgacccacggtgaactgatcaccaggtacacattcaccggcaatgtctcttgatcctgcatcattttactgataactttggcatcttggaatggtaaattgatcaagttggtttccaaacgaatcgcaacatcttcatcggatgccttgacctcgccatatgcaagcttacctaagttcagttgttcctcaacgtagtcatacaccggctgcatcactttggccggatctttcatgatgtcgtcgagcttcttggtgaaagatttgccttcaatcttttcattaaccaaatcatccacgaaacttgctgcatctttttccaaattagtcacctatcttcttaatcctttttgcttgttaatccgccgttgaaatgtatcgtgttgaagcactgctctcaatctgaacgccaagatataccaatagacgttgacgacaattccaaatgcggcaaccgccgacacaaacagcttgaccagaatcgtcgcgtcactattcaggaacatcgtcgaaatcatccccacgaagccaaccgaataaatggcgatcaccactgccagcagataatagctgattttaacccgtagtgcggccaaaatcaacgtggccgcgtaaaaggcgatcgcaatccaagtcacctgcaatgcttctccagtcgtggccggtgctttcagtgccatgaaaggcaatgtcatcaaccaagtcactgccaggaaaaccaccaacgagatgattgcccagaaaatggtctgcttttcttcttttttcatttaactttttaccctccagaattccaacaaaaaaagataaattcgatgatggaatttatctttttattaccagttttagtgtaccttattaaagcggtttagaaaagcatatcaaagaaatcatcacgagaaattccggtgaagtactggttcaaatcaacgtctttcaaggcatcttcgaagtctttacgttcgaaacgaacaccctttaatttgtcggcaacttcagttgaatcttgtgggccaaagtaatccccaaagaatttaacgttggataccttgccgtcatcaacttgcagacgggcatcaatggttccgttagtgaagtgttgacgcttcttaacggtgaattctggtgaattgccatatacccaatcccagttgttgtagtaatcatcaaaaatcttatcgatgcccttttgatcgtcatcggttaaatgatattccttgtccttgatctggtcgaggtcatccacgtggaacaactctttcagtaaacgatcacggaattcaggagtggttaagtcttgatacttcggtgacaagtatggtttcaagttggtaacccgtgagctgactgacttgattccctttgacttgatcttgtcttcaggaacgtccaaagcctttggaatgactgacaaatcaacatccagcatcaatgtaccgtgggagaacgtcttgccgcccttggtgtacattgcattgccggagaatttcttgccgtcaaccaaaatgtcgttacggccactaacttcaacggacttagcgcccatgtcgtgaagcgcgtcaacgattggttgaacgaatgacttgaagtcaccaaactcttcactgtcactgtcaaccacgaagctgaagcaaaggttgcctaaatcttggtagacagccccaccgccggaaagacgacgggtaacaacaattccgtgttcatcaacatattttttattaatttcttcaagagtgttttgattacggccaacgatgatacatggtccttcaatgtagaataaaagtaacggttcatcaaattttatctcgttcatcaaatactgttcagtagccaaattgcgcctgatatcattggatttcatgacataatagtacataaaataacagcctcttttcatttacttgatcaacttgaatattagcacgttaggaaagcgattacaatcacaagcaaaaagttgaaaattttaattgattacaagcatccaagagaatggtatagtttaggtaaggacaatacgaatacggggtgattgacatgcaacagcaaaaatatgaaaatgtcttggtaccggtagatggctcaaaagcaaccgaaaaagtgctgaatcgagcaattgaggtagctcgggacaacgatgcccatttggatatcttaaacattttggaagtaaaccaatttaaccaaacttatggaagtgctgtaagtggggacgttgttttcaagttaactgaaaatacggacgatcagctaaagaaatatcaaaagaaggctgaggacgccggcgtcaaaagcgtcgacatccacatccgatttggcaacccgaaaccaatcattgcacgtgaatttcctaaagaccacaacaacgatgttatcgtgatcggctccaccggcctaagcgccgttgagcggttgattatcggctcggttaccagttatgtgacccgaaccgctaaatgcgatgttttgatcgttcgaccaaaagacaaagtaacaccaaacaaataacaaaaacagcgtgtgggcggcggcaattatgtcgacgcctttttgctatcaacgattaaggacaatgaagatgaaagatattcagtggtgttttaatgagactgtaccggaagccatgaacggccgtcccttaaaggcgcttttaagtaattattggcagctgcccaagcatctggtttacagtattcgccatgccgaacgagtgctggtagacggccattatcagccggtaaatttcccggttaaagccggcagccaagtccagctgacttttgtgccggctgattttgccagaccatttccaaatgtcacggctgattcagcggccacggtcgcgattctctatgaagatcaaaatttagtcgtcatggataagcggcgcggtgataaaacccatcccaaccaacctggtgaagttggggcgacgattaaccatttggcggcttatttggcaaccgaaaagaccgttccctacatgattcaccgattagatcaggagaccagtggggcgattattttcggcaaaaatccggtggtcgtgccaattttggtggccaacatcgccaacaaacaaattaagcggacttatttggcctgggttgagggaaccgacttacctgatgaaggcacaatcaatctgccaatcggccgtgacccagatgacaaacgtaaacgaaaaatcaatgggcctcacgcggctcctgcgttaacgcgttatcgcgtactgcgcaaacagtccgggtacgcactcgtccagatttcgctggaaaccgggagaactcatcagatccgggttcattttgccgcgcttggtcaccctttagttggggatccgctgtataattcaagtaatggtagccctttcttgatgctgcattcttggaaggttgatttattaatgccattcactaaacaacgaaaattaattgaggcacccattccggatcattttatcaagtttgagcaagaattatcccgtcattaaccgtgccttagagaggagtcgaatatgacagaaacacatttatccagttactcggcaactgaattatcagaattaatccgccaagggaagttggatcgggtagcactggtccaggaactaatcgataccgtggagcagaacaatccaaagctcaacgcagtcactaccttatggggcgatcgcgctaaaaagatggccagtcaatttaacgataccggccaaccatttgccggggtgcccattttattaaagggccttggccaatccttcaagggtgaacctgataccggcagctcaatgctgctcaaggattacaagtcaaacattaccaacaacttcgttcaagctttcttgaaggccggcctcatcccagtcggtgaaaccaatgcgccagaatttgggttcaagaacgtcaccgactcaagattatatggtgatgctcacaacccgtggaataccgattatcaacccggcggctcctcaggtggttcggcagctgcagtcggcgctgattggctgccaatcgctggtggaaatgatggcggcggttcaattcgaatcccatcatcattctccggcaccattggcctcaagccaactcgtggccgggtaccaaccggcccaggcgagtggcggggttggcaaggcgcatcaatcaactttgcgattacccgggatatgaatgacaccgcccgcttactggatgccatatcgactgtccagatggccgccccattccaagttccacttccagcagcctctttcactgaaaccttgaacagcctgcccaagactttgacaattgcttattccacagaatcgccagttgggacgccggtttccgacgaggccaaacaagcggttatggatgccgttcagtttttgacagatgaaggatacgatttgattccggcagacgcgcccatcgacggtgtcgggttaatgaaaagctactatttgatgaacgctggtgaaacagcaacgatgtttgccaacatgcacctcaaagatgacgtcattaaggaaaacgttgaaccgttgacctgggcgctcggttatgccgggcgagcagtgacggccgttcagtacagtcaagcactgactttttgggataatatcgtcagtgatatggatgccttccagcaggaatttgacctttacctaacgccaacaactgcccatcaagcaccccgaatcgatcaaccattagtctcagctgagaatttaactaaaatgaagcacattgaagaattaaatccagaagaacaaatgcagttgatttgggaccaatggctgcctgccctgaccttgtcgccgttcactcagctggcgaatatcagcggccaaccagccatcagcctgccaacctatgtcggagaaaatggtctaccgctgggaattcaattcatggccagaaaaggtcgtgaagatctactcctacagatgggcaaattcttcgaggataatcaaaaatttcatttacttaaggactaatcagtttcacaacatttgaggaggagatcgcatgattaatattcgcaaactaatcggcttactgacaattaccggggcactcggtgttgtttcaatcacatcctcaaatccagtcctcgccaaacataatccaaaaaccaccgcaattaaaaaagcaaccaaccagccggccaaccaaaacgccttaaccaagggaaatgttcccaagctttggtcgcaaggctatcaaggccagggaatggtggttgcggtcatcgatagcggcgtgcagaataatcaggaatttcaactatctagtaacaccacagccaaaatttctaaatcccaggcccaaaagtttatcgctcaaaggggttacggcaaatacatcagcccgaagattcccttcgcctacgattacgtcaacaataataacgatgacagttccgcagacagtgtttccggtttccatggtctaatggtcgccggcgttgccgcagcaaacggtgtcgcacgaaggagcaaagccaaatttgtccaaggagtggctccggaagcccagattctcaatctgaaagtctacggtggtttctctgatgaatcaccaaacgacgttgcgcgggcgatttatgatgcggttgatctcggggcagatgtgattaacatgtccctggggatcggcgtcggtaatgaatcactcaatgatcaggaacaagcggccgtgaaatatgcgaccgatcacggtgtttttgtggctgtcgccggcagcaactatgggcatgcgggcagtatcaccaccgattataatgagcaatccaattcaacgattacgacttatgaaccggctaactctggcaccatcagcgatcctgccatttcaccatttgccaccacggttggcgatgaaaacaccaagcagggtgacaagagcgagatggattctttctcggcttgggggccgacaccggattttaagttaaaaccggatgtcagtgcgcctgggcagcaaatcgccgttttggatcaaaataatcactttacgaccaacaccgggacctcatttgcctcgccgtacattgccggttcggtagctctactcatgcagaaatttaaaaaagatcagccaacgttaactggtgccaaactggttgaggcagtcaaagtagctctgatgaatgccgcccaaccaatggccaacgacaaattcaaaggagaactgatttcaccccggcttcaaggtgccggtcaggtgaatgtcaccaatgccgctaatctaaaggcatccgccgccgatccaagtggtaaccaaggatcaatttcattgaaaacaattggccaaaccaccaagttcaacgttgccctgaccaatcacagctcagagccgttaacctaccatatcaacacggcaaatgggccgtttacagaaagccgaaaaaccaacaatcataatgttgggccggttcatgacactgcgatccctggtgccacactgcaatccgccaatgataccgtcaccgttaaccccggcaaaacgcagctggttccttttaccctcgatttgggcagccaagctaatttgaatagcgtcgctgaaggttatctaacttttgaaaatgccgattcaaatcaaaatttgacggttccctatttcggctactatggggatccaactgatgagcaggttgtcgataaacccgccaatcaggctgacagtattttcaacggtggctacctaatggacactcaggatatgccgctgggattgagtgaccgaacctctctggccagttggttgaacaccttgaaggatccggacgaactgcgagacgatatgccggaaaaaatccaatccgacaaggtggccttctcacccaatggggacggccattccgatgccatcagtccatacgtgttcaccacccagaacctccaaaacgtcactgctgagattaccgatgccagtggcaaggtcatcagaaccgtcgacaatgaaaccaacacccagaaatcaattgaagaagccggttccggctacattgacgatttaaccctttcgccttcgatgcgcttgaaccccaaggcattgaattggaatgggatgacttataatcagtcaaccggtaagatgacggtggttccagatggtcagtaccactacgtcttacaaaccaccaatttcaacgatggcgccaagcagcagcaagaatacagtcttccggtcaaagtcgacacggttgcgccaaagattaccaaggcaacttatcggaacggccgactggcggtgaactactccgacgttggggttggctttacttcaatatcgacacttgccgtccaaattggtcatcagtctgcaggcgtcagcttgaacaattctggccaatcaaataccggcagcctggtctacaaactgtcggaggccaagcaacgcgcactcaagcaagctaaaggcaaactaaagatgacgttggccgacgttgccggtaaccaaaccaagcgttcgatcaaagtcagtccaaagatgtataaccacgttcaaacgtcatcaacccctggttccaagcttgtctggacattgaaaaccgatgacttggaatcaatgatgagtcacgataagtatgcggtgaccacccgtttctcaccaactaaggggattacatttaaagggttaaacgacaatgacttcaccttaatcaacgcagccagcaacgtgtatgatccgcagacccatcaactaacgattgctgggaaagcggctaacccgaagtcgaagttaaccattttacgcagccccaaccaaaatgcgaaaattaaccaagtgaaaatttcaaaaactgggtctttcaaatttgagatgccaattaatccaacgacccagcaagggatcggctacatcctaaaagtacccaagaagcatcagtggacaacggccaaaggtgctctcgtggttattgccgacacaaccgcccctacgctgaatttatcgatgcctgacaatgtttccgaaacctcacagaaccactatcaattaacaacttcgaatgatcaattcaccatcagcggtactgtgaatgataacgttgatggctatcgcctcttgatcaatggcaacaatcttttccatgagcaaaataacgcgggttgggtgaaccaccaagatttgggtgccaatcccaatccccacagtcctcatcaattcactcagacctttaacctgaatcagggaacaaatatcttccaggtttctgccgttgatgagactggtaatcaaatcacaaaaacaattaccgttacccgcgagtaattctcaaatatatatgtatcaaaaaaggagctcgaaatcatttctgatttcgagctcctttaaggttttagtaagcattaagtcgtaatgaaattacttcttaaggccttcccacttccagtcaacaacttctggaagatcagtaccttcttgacggatgtaagcattgtgcttatcaaccatgtcgttcatacgttggatgaagtaaccacccttaacagtgtaagctggaatatcttgaacagcttcctttgcaaggtcgaaacgatccaattggttcaagacacgcatgtcgaatggtgtagtgatatcaccattttcacggtagccatgaacgtgaaggttatggttgtgacgatcgaagaagatatccttgataaggtcttcgaagccatggaatgcgaagataactggcttgtcagtagtgaacaagttgtcaaattcttcatcactcaaaccacgagggtcaaccttaggtgaacgaagcttcaagagatcaacaacgttgatgaaacgaatcttcatttctgggaattccttgttcaagattgagatagcagccaatgcttccaagttaggttctgagcctgcggcagcaaagacaacatctggttcttgaccttggtcagttgatgcccaatcgatgtagccaagaccattcttaacgaggttttgagcttcatccattgtgtaccattgacgacgtgggtgctttgaagtaacgattaagttaatcttctcgtaagttctaaatgcaacatcaccaacagctaacaattcgttagcatcagctggaagatactcacggatgaattcaggcttcttctcagctaagtgagttaacatacctggatcttggtgggtataaccattgtgatcttgctggaatactgttgaagtatcaacaaagttcaatgaaggatattgctttctccagtattgttctgaagctttacgtaaccacttgaagtgttgagtcaacattgagtcaactactcgtccgaatgattcgtaagtagcaaagaatccatgacgaccagtcaatacataaccttcaagccaaccttctgcttggtgttctgaaagttgtgaatcgataacacggccgtggtttgaaagatcttcatcaaatggttcgtgaatgtcttccatccattgacgcttagagtcatcaagcaagctgtaaagacggtttgacttagtttcgtcaggaccgaatccacggaagctggtagggttaagttctgcaaccttttccaaccagtttgaccattcaatcatatcttgcttctgagttacaccacgatcgaatttaacttcgaagtcgcgaacatcagggagcttcaatggttctggtttgataccaccgttagtgattgggttaactgacatccgcttgtcgcccttaggtgcaactgcacggatttctggtttaacagtaccattttcatcaaataattcttcaggcttgtatgacttcaaccagtcattcagcaagtctttgtgttccattgaacctgcggcaacaggaattggaacttggtgagcacggaatgaaccttcgatagggttaccatcgagatccttcttaggaccagtccagcctttaggtgaacggaagataatcattggccagttaggtaacttaacgttatctggtgtttcgttttcacgagcattcttttgaattgacttaatctcttcaataacatggtcaagggtcttggcaaattcttcttcaaccttggcatggtctgtatcagcagttgcttcaacaaagtatggatcccagcccattcctttaaagtaactagttaagtcttcgtcactcatacgtgaaaggatagtagggtttgaaatcttgaaaccgttcatgttaatgataggaagaacagcaccatcagtaattgggttgatgaacttgtcagagaaccatgaagcagccaatgggccggtttctgattcaccatcaccaatttcaacagcagcgattacatctgggttgtctaagatagcaccggtaccatgtgaaagtgagtaaccaagttctccaccttcatggattgaacctggtgtttctggtgcggcatgagaagcaactccacctgggaatgagaattgcttgaataatttagccatacctttttcatcttggctgatgtttggatagatatctgagtagctaccgtcaagatatgagttggaaaccataacttggccaccatgacctgatccttcgatgtagaacatgttcaaatcgtatttgttgataacacggttcaattctgcatagataaggttttgtgatacgatagttccccagtgaccaataggcttaactttaacgtctttggcttcaagaggtcgcttaagtaatgggttgtcgcgcaagaacaactgacctactgaaaggtagttagcggcacgccagtacttgtcaacaagttccaaatattctttggaatcgtaatctactgtcattaattaacactccttcttcgatttagcaacaaacttctgtatagaatgtccgtaaaattcaccaactgtttcttgatcaatttacatcactaatactaaacgatattttcaaaaagtcaaccttttagaaaattgatacggtccaatatttagtgggcgaaaatcctatacttatgtgccattatggacgctaacaaatatttagtccactattattaatattttgtaacaaaattttcgaacattttactcacgtatttttccgtttgaaattgacggccacttggacgataaacaatagaacaaaaatcgccgttgtgatccaaaatgtgaatcgcattccaaaaatgaatgcttctggttgagcaactggataatcaatggttgagtggccgagattcatactgataccagtaaatagcaggatgtttgcgaaaatcgctccaactgtcatcccggtattccgcgagaaccccagcagtccactggcaacgcccagctgatcttttgataccgagttcataaccagcacgttggttggtgcttgaaacaggccgttgcccaagccaacaaaaccaagccagagacataagatcaatagaggtgttgtatggttaacgctcgccaaccccgcctgacttatgatgagcatcgccaaggaaatcgccgcaatccggtgtgatccgaatcggtcgctgagccacccggcaaacggtgagacgataatttgaatgatgggaaaactgatcaaaatcaagccggccaggtcggtggtgatgaatcgattctgctccaaatagattggttcgatgatgttgacgacaaaattaattccataaactaaaatcgtcgcaacaggctcagcgaaaaatcaatattgctgaataaatgaaaattcatgaccggatcggctgcccgtttttccaaataaataaagataatcagtaaaatgattgtcgcaatcatcaagctgagaaaaatcaaactcatgaaaccaacttgttgacctaaaatgaggcccataaataaactgccggccataaaaatcaaaaccagcatcccccaagcgtcgattttaccagcagttgttgcttcagctttcggcagcacaatttggccaaggataattgccgcgatcccgaccggcacgttgacccaaaagatgtagttccagggaaggtaagttaggatgaggccgcccagacccggtccggcgatactcccaagggcgaccaccgaaccaaagctgccaagtgccagtccccgctgttctttagaaaaggtctcggtgataattccggcgttggtgctcaacgtcatgctggcacccaaagcttgaattccccgcatgatcaagatccagacaaaccccagattgatgccgcagaatagggaagcgatagtaaaaatcacggtgccaatcttaaaaacccgggctttgcccaacatgtcacccaacttgccaaatggcaataagaacatgcacgtcacaattaggtaacttgaggccacccacgtcacttgggcagtcggcaccgccattgctcgggacatgaccggcaatgcaatgttgacgatgctgctggtgagtgtcgacatgaatgacaataagacgacggcggtgaaaatccaccattgattttgctgattgacttgcctggccatgctgcgtgcctcctcccgaagattcaaaactttcatctataggataggctttttcagtggcgtggttggaaaatttgctcacaaaaatactgcaggaatcactgtgtgactcactgcagtagaataaagatttaatgaaacatatgtgacataacttcggtgcccattggcgtggcaacaatcgccgcaaagatcagtagtaagatgccgatgaccatgaatacgcctttaactgctgggcgatttttttgtctcagaccatagattaaaatgagtaggcctaggattgcgatgattagcatgatgtagaaccccgtgggatcaccttcttttggttgagtggttctgggtgttggctttttgctcttttgaaaatatcttttaccgagccgaaatgggctccgacgggccagatgctaacttctaaacccgctttggttcaaacccaaacccggggtttcaaccaaagctggcttagaaaccgcatctcccggccctcgtcgccctctgctacttatcctcatccaaattcacaaaggtattataattcaaatacttataatgaatgcgcatatttgaaacttcaaacggcgtgccatcatccaagaagaaaataccttccatcacgccaactggttcgaccggcttcaagcccaacaactgctggtcttctttggtcgatggatccgctgtgatggtcataaatgacttggtaaccgagttgccggttgcgtcttcaaaatagttgaagattgagccctccactcgttcgctgttgagttccggcgccactcgaattgggatatagccgagttcaatcatgaatggtttgtcgtcaaacgatcgcagccgcttaatctcgtacacaaattcacccggatttaaaaacaattcggtttgaagctcttcgcttgcgggaacgaccttaaaatccaacaacttaattttaggcgtctgaccatcactcttaaagctgtcagtaacccccaggttggatccctcgtattgaaaaatcgtctgattcttctgatatagcgggttaataaaggttccagaaccccgctttttaaaaataatgccttggtttgccaaaacattcaacgcgcgtttaattgaactgcggctaacaccataggattcgctgaggcttcgttcatccggcagcttctttgaggcaaattcattggcctgaatgcgctccttcaaatccttcatgatattgcgatatactaaatcagccatttgtgctccttattaaatcgttaaattgatctattatcaataaagtataacagattatcatcttttgttcagacagaatcgttttgccgattgtgctaaaatatccctgaggtgttatcaaatgtcaaaaaagaagaaaaataaagttcataaaacattagtcgaacaaattctcgataagcacaaaattccttttgaacagatggaatttcccacccacaaagaaggcgacgtcgaacaaatcagcgtcgaccacgtggatactgacgagcaccagatttttaaaactctggtcttctccggcaaaaccactggcccggttgtcggtgtggttccggtcgacgaacacttggacgaaaaaaagctcgccaaagtttccggcaacaagaaagttaatcttgtaccgttgaaagacttgttgaagacgaccggctaccagcacggtgccaacacgccaatcgggatttgggaaaagttccattaccccatttatgtcgaccaggaagccaaggagatgggggaaatcatcgtctcatctggacaaatcggccgttcagttaaggttgactcccagcagatggtcgacctgatcggcggcaaattcgccgacataaaggaatgattgaatgctcaaagatattctaacaaatattggtttggtactcggattaatgatcggagtaccatttctttttatctatctattgtcatccatcaaccacggcaccaagcaacggattgccaatcaatttggtattggcggacaaatcggctttggctttctggggattatcattcatgaagccagccacttattggtagcgttagtctttggccaccatattgatcagtttcgcttgttgcgagtaccaacggcagacaataataccctgggatacgtccaccacacttggaacaaacgcaatctctaccaaaatatgggtaatctattcatcggcgtcgcgcccatctttggctgctgtttatctgtcctgctgctggcaaaatacttcatccccgaagtctaccaatcattgatgacgactgctgaacagccgctgagtcaactaatcgtggtgctgccgacttttaactggctttcgatgggcttatttctgataattgctgccaacatctgtattggtggttttgatttgagccccgccgacttcgacaattccaaacagggattctggcagggggtcatctgcttaacattactggccgtcatcatctcgctcaccccactccaagcgccgtttttcagcttactaatccgtttgacggtgattatcgtggtcatttcactatttaatttactgatttcaatcgtgatgaacctgatttttcggtttatttagtgccattccattcgtcgacaaattcgcccacaaagtcctgcatgacctgttggcggtgttcggcgatttttttggcggttggcgtgttcatctgatctttgagtttgaataatttctcgtaaaaatggttaatgaccgtcccgcgcttacggtattcagccttatccattcccgtccgcggcataatccgtggattatacataatttcaccgaagtggccgccaaaataaaaggtccgggcaatcccaatcgcgccaattgcgtcaagacggtcggcatcctgaacgatctgcccttcaatcgacaagtggtggtgggtcttcagattggcactgtaggacatgttatcaatgatttcgaatacttgcttaacaaacgcctcatcataaccaacgccaatcaattcatcagcaattgccttgcgtttggcagccggattggtggtgactttatcatcactcacgtcatgcaggtaagccgcaatgattaccaatgactcatcagcatcctcaccttttaaaatcaacttggccaaactgaccacccgctcaatgtgcgtgtaatcgtggccagtggtttcgtacccaagctccttttgaacaaacccgcggatttgtcttagtccattaatcatttgaaaaccccttttaaatatttatcaagatgctaaaaatcactcgaagaatcaaaatcccccagaataactgccaatagcgcagatatgtatgtttaagcgatgcgaaccaggtgacgaaaaacgtccaccagtggacccgactgcgattttggccataaaagtcgctcatttctgcaatcatcacgaaaagcaacaagtgcagcatcatcaacagaagcaagtcgatgacgtaggctgtcgccaaataccatcgagcaccacttgaagcaatctgaaatgatgaagcgaccagggaacccagtccggcaacatttagcgccccagccaaacttaaccaaacagatgagagaatgtaggtcggaatcagtgatagcaaaagcagcggcaggatcagccgggtatcactgaccagctcttgggcagttattgagggaatcgcaccgattaatgaccgaatagatggcataacctgaatttcactagcaccaaattgaaaccgcgtacccaaaaagaagacgactgccgcaactgcccaaacaatcacaaaaaagttcttccggtaggctgtcgcgatcgagaccagctgtgttttaagattggaacgagtattccccaatttgaaatccccctactttattcaaacaactattagtatacccttgcaccgtcaaagctgaaatagccgtgctagaaacggttattctctgctcaaccacaaaaagccgtcaatccgagaatgctcatggattgacggcttcattaagcatgtcactttattgaattgaatagactgactggcccttcaaggccgccttataagctgcaactgccaagttgacctggccgacgccatacaactgactagtggcatttttaatcgagccggttttgttcacatacgtcaacatagcatacaacggagttgccttttgtccagcgtgcatagctgtgctgttaacatattttttggtgcttgacccattcgccagggcaatgatcgcctcagccgttgaattggcatttggggtggtcttgccgttaaatgtgtatccgaaagcaccattactttgtgtcagaccgtacaagaactgctggcctttcttgatgcttgattcaaccggactggttgttgattgtcctcgtgataatccagtcaaaaccatactcgtcgtatcggcgtccttagctccttgtgcgttgttataggtccagccattattcttcagttgaacctttaccaaccgggaactcaagctggccttgctaaatttggcattgctgggacgtttgaaatgattgctcatcgatacggcaatcaaggtttcggcctgagaactggccgtctgcttggcaacgctgcttcgatacagtcgtgagaccaagttaatgcccgttttatggccatacggcttgtagttctgcgcgttcatccccatggcttggacggccatcacggcattggccaaagttgcggcggtgctattgctcttaatgaccaagtttttcctcaggagattcttttcgcctgtggtgaattgataatggttccctttcagacccagtaagaaatcagaataaccagaggaagccccggtttctgagtaaagtttccggctgaaaatcgagctggtcttaccagacaaacccgtcttgttttctttaagcatcttctttgcgtaggcgtatgtcagtgcagtccggcggtgaatcgttgacgtgctggccttatgaatggaagctgcaccggcattggccgtcaaggtgacggtcatgaccactgcactaatcgaagctaaaatatttttagttaattgattcattttgaatacccctcttatttattgtaattcagagaaatccggtcaccattggccaccacataggcaccaatcgatgtattgggctggttaccattaatcgagtaaagccagccggtcatcgtgccggcggggccggcgttatagccgttaatccctttcacataagccgtgatgccggagccgaccgttgtgatcgacatgttgtgctgagaagccagcgcattcaaagcatccagcgcggtggcgcctttggcaagggtaatgctgccactggccagcactgatccgttggcattgacacttaccgtgaccgtttcggtggtggcattcgtattcgtacctgaattgtcgttagtggtcccggaagtgttggtcgacgaagaactagcattgttggacccggttggcgtcgtagttggcacgctcggagtggtagttgtcgtggacgacgaactggacgttgaggtcgtcggtgatggcgccgtggcaaccggcgttccagctgcatcggtattctggccgctggtcttggcaatcttggttgccagaaccaaccgtttattggctgacacgtaccggccattggtgagttgcaatcgggacgtgtgcccatagtcgaccactttttcaacatttaacgaccgattctttttaacgtgtttctttcgcccgcttagttgtcgattactgtattcattgatgccctttggattaagaaccttaacccgggtgactttggctgagtagtaggcaccagtcaaatatttcgcagccgaaagcatgtagccggtcttgccactcctcaaatctctaacccgataaatggcatgaccctgttggttagtcgtctgcttgaggaccaaaaacattggccgattaatgcgggcctgcttcttgtagattttagtcagctgacgcttattaaaatcggtactcttgtaaagcttaacggtcgttaaagcataaacaaccgatcccttggcactcttggccttcttggttgtggtcggtttagtgaccggtaccgcagatgatgaactggaagccactgaagaactcgatgaacttggggcgctgttaataattgtcgtgtagttattggtaatcgtcgtgccactgctggacgaagctgcacttgaatcaacgactttgacattgttaatttccgcaacaccaactgcccgatcggcaatcgccgcttcatcggttgtatcagcattaatcttggtaatgtagttctcaagcgtttggttaatcgtgctgatcgcagttgctttgtcggtagctgacgattgtgaatcattgttgattgcttgccgtttggtcgttgcagccgcattaagttttgccagttcccgcgctctaaaggttgggttttcgccaaaattaaagatccacccctggccgccgtctttggtaaatttcgcttgttccaacgtgtaagttgcctgctggagcagcatggagttactgtcagcactaatatctttctggtccaataaccgttgaaccggtgcttgataatcagatttaccgtttaatgatgtgtagacgtcaacgccggcagcggcaagggcgttaaccatcgtaatgttattgtactgatcttccttattggtctgattcccaaagccaccattttgttgataataatcattttcaatcacactaaccgctttttgaatggcagctggaactccaggctgatccatattcatagaaagagcttgaatagcacgggccgtcaggtcaacatttccccatgaggacgtccagattccagcagctggatcgcggtcggccaagatctgtttagtcaaagtagcccgcgccgtttcgctggctttaccataactgccggtactcaatgcttcaagatcgttaaccaaggtgtacaaactcggtttggcaattttggccaatggatcattgataacttgacccacaaggtccttcttttcaacattagctgggtctttgcccagtgctcttaagccaatgaccccggcaacatctgagacaccgctcggatcttgcacagttccgcttaagaatccattagtggtgatgatatcctgataagcattttgggcctgagcatcagtgatgccattatcactcgtcgccaaaatcatggcatcccaagcatccaaggtatccttttgagcggtcagcttaacgccggtcgtaatcgccgaatcaacatcagcggcggtatcagcttgggcgaaggcttcgccaccaacaaataccaggaacatcccgactaccagtgatacccaataaataaactgtttcttcttcatacctgcgcgctcctccaaatcatgaaatagtgatggtaccctcaacaaaaaatgaacacaacaaaaaagcctggctagttagactagccagggccgtttctcaatcactaataacctaaattcagatattgaatcagagcacacaaaaatatccgagaaatacgctattaattgacaaagccgaccctaagaagctttgcaatcggcataacaaacgtatcctgacttgatctcgtcctacaactgtcctctttccagggtgacccagtgagttgtgacagcttcgtcaatcttacagtagcgaaggggctgtaaaggatttgcacctttttccgttttactatgcttcttaacatgaaaattatagcatggaatttgggtggatttagagtaattgagaaatttattgataatggggctaattgtttcctggcttgagaaggtgacgctcctctttttttgctggagagatattggtttctgcgaggactgggctgtttttgtggacagctacgcaaaacagcagaatctaaattagagaagagccccagccacgcgagtaatcgcgcaactgggaatctggtccacggttaccaagtgatcgatactattcaattgattgcttctttaaggattttcccagtttgagtctgcttttgaggacagctacgcaaaacagcagaatctaaataagagaagagccccagccacgcgagtaatcgcgcaactgggagtgttttccgcggttaccaagttgagaatgctatttaattgtttgtttatttaaggattctcccagtttgagtctgcttttgaggacagctacacaaaccagcgatacctaaataagaaaagattcccagccacgcgagtaatcgcgcaactgggaatcttttcttatttaggtatcgctaagcggtttgcttcgctcactatttttccacattagtcccctcataatcgtcaatcatcaactgtttcaaatcggcaatcaaaggttcctttgggttagcagtcgtgcattggtcttcgtatgctaatactgcaagacggtcaactgctgcatcgaatttggctttatcaacgccccaagccttcaagcttaaggtaacgccaacttcgtgagccaacttgataattctttgaactaatccttcgattaactcatcgtcgttcttaccttggatcccaacgtatctggcaatttctgcgtagtccttgttggcacggaagtactcatacttaggccatacggcgatcttttccggtaatttggcattgtatctgataacgtgtggcatcgtgattgcaatggcaattccgtgggttaagccgaattccccacccagtttgtgggcgattgaatggttaattcccaggaacgcgttaccaaatgccattccggctaaggttgcggcgttatgcatttcttctttagcgtgcatgttgccattgtatgagtctgccaagttgtcaaataccagcttgatggcttgcagtgacaatggacgagtgtaatcagatgccatggttgaaacgaatgattcgattccgtggcataaagtatccaatccggaagcggcaatgttaccctttggaacagtttccacaaattgtgggtcaacaatcgctacatcaggtgtcaaagcatagtcagctaatgggtacttaacgtgggtctttgagtcagtgataacagcgaatggggttacttctgaaccagtaccggaagtcgttgggatagcgatcatttgcgccttcttaggcttgttgaaacggtatgcccgctttctgatatcgatgaacttctgcttggcgccgaagaaactcgtcttaggatcctcgtagaataaccacatgttcttggcagcatccaatggtgaaccaccacccaaggcgatgattgtgtcaggcttgaatgcgttcatttgacgaacacccttttcaactgtgtcagtggttggatctggctcaacacctgagaacagtgagtattcgattgggtttggacggcgtttcaattcatcaagcaccttgtcaacgtagccaaattcaaccatttctggactggtaacgatgaataccttgttaatgccaggcatgtccatgaggtaacgaactgaagtcttttcaaagtaaacccgaggtaacttaatccattgcatattatttcgtctctttgcgatagttttgatgttcaaaaggtcatagtcggtaacgttatgagaaattgagttggcaccccatgagccagttcccaatgtcaatgatggggtcatttcgttataaaggttaccaattccaccgaagccgcctggtgtgttaaccagaacccgggctgccttcatctgcttaccaaattccaaggccaagtcgtcgtccagagtttggatgccggcagtgtggcccattccaccaaagtgaagtaattcgtcacagagtttgaaaccttcttcatggttcttagctttgtaaatactgatcactgggctgagtttttcagctgacagtgggtacttaggaccaacgccagtaatttcagcagccagaactttggtgttgtcaggtactttaataccagccagtttggcaatccctttagctgatttgccggcgattggacccttaacactgccagtcttagggttgaacattgcttctgccaatttgtcatggtccttcttatcaacaaagaagacaccgttcttaactaattccttcttaacttcagcgtagatatcagaatcgataaccgcgctgttttcagtggcacagatcataccattatcaaaggtctttgagagcaccaggtcgttaacagcacgcaagatgttggcagtcttttcgatgtaaaccggaccgttaccaggaccaacacccaatgccggcttaccagttgagtaagcagctttaaccatgcctggaccaccagttgccagggtacttgcgacacctgggtggttgattaatttcgttgtggcttcgatacttggttcttcaatccattgaatgcagccttcgggagcgccggcagcaatcgcagcgtcgcgaacaatcttagcggctgcaattgatgacttcaatgcttgtgggtggaaactgaagatgattgggtttcgagtcttcattgaaataattgatttgaataaggtggttgaagttgggttggtaactggtgtaattccggccaggacacccaaaggttcagcaacggtgattaattgacgttctttatcgtctttaatgacaccaactgttttgtgatcacgaatgctgtgccaaacttcttcagtggcgtacatattcttgatggccttgtcttcagcaactccacggccggtttcttcataagccatgagtgccaggtccatgtgtttgtcttggccggccattaccatttggtgagtgatgtggtcaactttttcttggtcaaatgaatccataatttcaagtgctttttgcgcttttgataccaagccgttgatgacagtgtcaacatcagttgtgttcgtcttagctgctttggtttcttttactttattatcaatcattgattttcctccaatgaaaagtttataggttgtttgtgctttgttatctttttcacaatattaataatatcacggatttttaaaatgtaaacagttttgttcaaaaaatcacaatttattttttgtaagtgcttgcacactgatataacaatatccaaaacaaaaaggacttgttcagcaagtcctttttttatgaaagcggttccattatttatatgtgaatgatttcacgactttggctatttggtcactttcgtgagtggcttttgaataatcgccaaaagtttctcggattggattcggtcaataatgacattgacagccacctgcattaatttgtcattcagattcttttcttccaatgcccggctgttacggctatccatgttcttgaatgagaacatgagccgtttgataaaagtgtcgtatgcctgctgcggataaatgttggccgtcacctgatcgattccgtgacgaatcgtttccagggaaaaggccggcttcaataagctgatcaaaatcagatcagcaacctgcatggtctgatacttccgcttgaccggtgccataatcgctttgttcttgacgtaattgttgatcattgccggagtgactttatcaattccgattggccccaacgtctcgttcaccagtgccacgagttgatccatgtacaattcaaatttgggtaaatctgcccacagcggcaattccacctgcttgagtttttgttcccactgctcgtattgttcttcattgtatgccatgttatcactccttcgagtttattataccacgttagctagtatgtgacactagatagtctaacttggagtggagtaagaggcgctttgatctcagaatttaagccggcaaaccaaatactcctgactttggaataattggtttgccggcttaaatggccgggatcagccgattgctgcacgtttccgctagataacagtggcgctcagcatctcagtcgtctcgcttttatttacttcccgcttgtttgcgcagtcgtctcttctcgcgtttgtccaagacagtggcaataaccccctgcatgaacatgtagagcggataggccgttgcgataagcggaatggcatacagccaaatgtctttattaaagaaggagaccaacgagaaaatattattaaagaagatgatgatcgttaaaaatgccaccagtaccaggatgtccatcccaatcttcagccggttcagtggccgtgataccatcactaatgccaaccagcaaattgccccggtcaacaggacacacagcgttgaggtgaactcgtattggagtccaaaaagctggccgatgatttcaattaacatcacgtagccaacaacacaaatcgctgctggcgttgagatgatcaacacctgcttcatgaactgattggtaatcttgttgaagttaggctccaaagccaagaagaacgatggaattcccaccattaacgatgtaatcggagtcaactgaataggttcaaaggggtaccccgtggcaaagaagacaaagataaatgacaacgcaacggagtacatcgtcttaatcaggtacatagaagcaacccgctcgatgttattaataacccggcggccttctttcaagacatcaatcatggcgtcaaaattggaattaatcagcacaaagtcagcaatactcttggtgctctcacttccggaagccatggcgatcccacagtcggcctgtcttaaagcaagtaaatcgttaaccccgtcgccagtcatggcaacggtatgttttttggactggagaccggcaatcagccgcttcttttggtcaggggttacccggccaaaaacggtattgttggcagcaatttccccaaagtcgtcttcatccttaaccgttgtcatatcaacgctgttggcagcatcctgaatgccggcctgttgagcaattgtggaaacggtggtcgggtcatccccggaaatcaccttgatattgacatcttgattgcggaaatattcgaaagtgttggcagcattgggccggatgacatcagaaatcaataccaggccaatcaactttggtgcgtcaagtggctttcgtggatccaaatcatccacttgggcaaccgccaggactcggtaccctttccgggcattttgagtaatcacggcttgaacctgttcatccaagtgttcaaaaataaactgcggtgccccaaacacatagtcgtggccatcactcaaaccaacgccactccactttcgatccgaggagaatgggatgatcttttcggtctttagctcaggatcatcaacagcatctttgatcgcgttggccgtttcattcgcgtcaccggtgccataggtaatcccggcaaccactttttcaacttccgcggcagaaacatccttcatcatgggaattgcctcgacaaattttagatcgccgctggtaatcgtcccggttttgtccaaacaaatcacgtcaacccgggccaaggtttcaatggctggcaggtcccgcaccagcgttttcttacgggccaaatgcatcgccgaaaccgccagtgtcattgaggttaacagcaccaagccttccggaatcatgccaatcatcgctgcagcagaacccagaatggcccgattgatgccggtgccgccatataatttggcaacaaataaaataattcccagtggaatgatgacgtacgtcaaaactttgataatccgattaatcgtatttaacagaatgctggaggcgtcctcgccctgcttggcttcgttggataaatggttaacaaaggtgtccgcaccaacagttgtcacctgcattttgccggaaccgccgaccagatacgtaccggaggttaatggatccccaatatttttggaaatggttaccgactcaccggtaatcggggattcatcgacttcaatcccccgtgaccggacgacgatgccgtcaaccgggatctggtcgcctcgtcccaactggataatatcgcccaggacaatatcgttggagtagacctgcagatcctcaccgtttctaatcacgttaatttttccttccgccaataagaccattttgtcgacttggcgtttggaacggatttcttggataatcccaatcgcggtgttaaagatagcaatccccagaaacagcagatttttgtagctgccagtgtagaaaaccagcgcccccaaaatcacgttaatcaagttaaaaagcgtgaacgtattgtcgcgcaaaatatccgaaacactttgggtaagtgattcctcgccagtatttttgtggccgtctttaatgagttgctcaacttgagcgtcactcaatccaacttcggggtcgacctgttgactatttccgtctgccatcgcttaacacctcgctttaccataattgtacaaaattacggccgaaaatcacatttatttggacgcaacgaattaagtttatcggatttttatgattttcaggccaaaacgttgccaaacatcgactggcgggtatgctaaaatgaatctaactaactcgcaagggggaaatgaaatgtttcaaccagataaaagcacctatcaattagccgatggccatcaaatgccaaagcttggtttcggcacttataaaatcgacaatcccgaattaatggatcattcggtagccactgcctatgacagtggctaccgaatgtttgataccgcgcaactctaccgcaacgaaaaacagctcggcgacgccatcaaaaaagttgccagaagagaagatgtcttcattatcgacaaggtcatggaaatgaaccagggccatgatttgaccattaacagcaccgatttttcactccagcagctgggcaccgactacgttgatctcttattaattcactggccggtcgctgaacacttctttgaaacttggcaggcaatggaagaattgaagaagcagggcaaggccaaatcaatcggcgtcagcaatttcacccgttcccaattggaattactgaagacccaggccaacgaaatgccggtggtcaaccagattgaaacccacccatatctcactcagcagcctttgatcgatttcgacaagaagatgtcgatcgtgacccaggcgtggagtccgttgggaagaggcattgtcttggataatccgatgctcaataagatggccaagcatcatggcaaaacgccggcccaaattattttaagatgggacctccaacgcggaatctccatcatccccaagtcaaagacgccggcgagagtcaaagaaaataccgaattggactttgaactcagcccagacgagatgagcatgattgacgtcatgaataagaaccagcgaactggcaatgagcctgaattggtctatgaactgggccaccaatactaatttgggctcgcaaaaaggaggctttcaccatgtccacagaagaacaacggatgctgtccggtaaactctataacgtttacggtaaggacttggccaagaagtacgccaaaaaagatcatttgcttcatcagattaattttgccgaagaagggaccgacgttcaaaagctcttcagacaactgctgggtcgaaccggtaacaacgtctattttgaaccgccgtttttctgcgactttggcggaaacattaccgttggcgatgatgtctactgcaataccaacggcgtcttcttggactccggcaagattaccatcggcagtcgcgtcctgattgggccacgggtcaacttatttgctgccggccacccaattgatgccggtgtccgcaatcaatggctcgggttcgccaagccaattacaatcggcgatgatgtctggattggcggcaacgccaccctgaatcccggtgtgaccattggcaataatgtggtcatcggttccggatcggtggtgactcacgatatccctgccaattcggtggcggtgggaaatccctgccgggtcatttgaccaatcaccgcagatgataaaactgagtgggaaaatcaggaagctgaataccggaaatctttaaagtaatatttcaaatcttaataaggaagtgatggcatggcccttggacaactgacgaatcaaattgtgttgatgtttgtattgatgttaattggtgtcctcatcaacaaagtcgggtttatgcatacccagacttccaacgatctcactaacattctgctgtatatcgtttcgccctgcctgatcattggggcatttgaacaaacctattcggctgctcgcatgaagcaattgatgctggtatgtgtcggcatctgcttcttttacataattgaaatcctcatcgccaaattttcctttggccgcatcagcaacatcgacctacagcgaattaccaaatatgggagcatttactccaacgccgggtttatgggcattcccctgacctccgcattatttggcaacacgggggtcttcttcgccgtcgcgtcactggctggttttaacatttttagctggacccacggtgtttcattatttaaaacgaccaagaagcatcccgaccactggcagaactttcgcgaaatcatcatcaatcccaacatcattgcgatctttgttggcttggttattttcctactatcgtttcagctgccgacaccggtcgaccgcgtcattcactacgtcagctcgattaacacgccgttgtcaatgatcgtcattggtaacagcttgggaaatattcgcatcagccgtcaactgattgactggcacctatggttggcgatcttctttcgcaacctgttattcccaatcgtggcgatgctcattctccaagcattgaccgtttccggggttgccttggatacgactgtattgatggctgcctgcccaacggctggtttggtggttctgttcaccttacaggcatacggagatgccagcccggcagttgcgttgatgagtttatcgaccattttgagtttggcgaccattccgttagtgtttgctgtaatgatggcattttaaatttgataaacctgaataaaaagagggggaaacaaagcattgcgcttgtgtttccccctcttttagcattcattattattccaaaaaaaggattgaccctcatccccacttccagggaatcggcatcaatccctttagctttagtgaaattcgcaatcgtaactggattgttaaattcactaagcaactcaattaaaaattaacgaacgatcttttgacccattacgtcagctaatttctttaaagcatcgtcacgagtcttaatcacatccatgttccaaatgattgtgtcgatttcacctccggcatagtcaaacttttcataatagatgtaaggatccttgtcgctgtctttaaatacattatcgatcttgtcggcaaatccctttgaccagtcatcgtcatccatttctggaatatccttcttggtcacgtaaccttgctcgttaatcagatcaactgcttttttaatttgttcgtcggtgtatttgaggtctttatcattatctcgttcttcggcatcggctttcttttcggcagcactttcctttaccttttcagccatgataacatcccctttattttgatctatcttaatgctagcactgattgaagacaatagttaagaaaaacgaccatttccatcaataatatttcaaacacttttaaaaataccttgtgggggcgtataattagatgtaatctgtaggttacagattgatctaatttgaatatatcatttttgaaatgaggaattgaattttggacgatagccagatactgactaatctaattattgtgatagtaacgtttttgttcgctgctttcttcgtggcaagtgaatttgccctggttcaaacacgggcaagtgcgctggaagaacgcaagaaaaatctagaagaagccaaaggcaataaagccaaggggttaaagaagctcgaccgtgagattcacatggtcaccaacctgaatgaatatctttcgaccacccaagttggtgtcagcttggccggaattatcctaggttatctgggtgaatcatttgtggtcacaattttggttgatgtgatggaaatccacaactcgccaattgatccaaccgctgctcacgctgtgggcgctgtgctggggattatcatcttaacttatttggaagttgtgttaactgaaattgttcccaaaaacattagtattgatatgccaatgcaggtgctgtcctttatcagtacgccactgcattatttccatgtcatcttttatccgtttgtctggttgctcaacatttcagccaacggaatcgttaagatgctgggcttaaaagttgccaacgaaaacgacgagtcgttctcacaagcagaaatcttgaacctgtcgagaaatgccgttaagagcggtgcccttgaacagaacgattatctgtacatgcagcgggccttccagttaaatgataaggttgccaaagacatcatgattgaccggactcagttggtcgtcatcgacattacaaccacggttaaagaagccgttcaagtctatctgcagcaaaagttcagccgaattcctgtggttgccaatggcgataaggataagattctgggctatgtctacaactatgacctgattcgtcaatctcaagttgaccccaccatcaagatcgaccgcctgctcagagatatttcaaccacgccggaaatgacgccgatcactgatgttctccaccaaatgattcagaagcggacaccaattgtcgtcgttgttgacgaatacggtggaacttccggaatcattactgacaaggacatttacgaagagttgtttggaactgttcgggatgaaattgatccatcaattaccgactatatcttcaaacagccaaacggcacctatcaggtgaacggaaaattaaccactcatgactttgagcgatactttgatgctgatttcccagagtttaccaattcagacgccgttaccctggccggatacttcttggataactacccggatatcaaggccggcgacgtgatctcatttgagaacttcgatttcaaaattgttgactacgaaaactcatttatcaactggtttgaggtaaccaagcacaaggtcgtgccaaagcctgacgatgatgacgatcaccatgacaattaatggttaaagtttcaataagactgtgacaagacaattgttttgcgagcagtctttttacatattagagacgatttagacatcataacgtttaagggggatctaacaagtgaaaaagctatggcaaaaaacaccagcgtggatcacatacacggtgctgtttaccgcgctgatctgtgttttagtcggttgcttgttcttaacaggtcgatcaatgatttgggagctggacgggatggcccagcactatcccattttagtgcagctcaggcacatgatactgtcatttctgcacaatccaagtggcggctttactcattgggcctggaacatcagcttagggtccgatcagctgaccaatcttgcttattatgtgattggcgacccgttcaattacctaattgcactatttccaaagagtcagatcgaaaatgtctttgccttactggtctttctccgaatgtatttttccggtctgagctttatgttgtgggcttcatcgtatcaatttaagaagtccagccggatcatcgggtcgatcgcctatgcatttaacggttacgccttggcaactgctttgcaccacccattctttattctgcctttgattttcttcccactgctttgctacggcatcgatcgcgttttacataacaagtcatggctgcaattgatctttgcggtcttcctggtttttttaagcaatttctactttgcctggattctgggatttggttcaattgcttatgtcattctgagaatgctgagcctgagaaaatggcctgattttacgccactcaaatcctttggtaaattggtcctttcagcagcgattggccttgggatggcggccatcgtcttcttgccaacgattattttggcgacgggctccacccgactcaatgacaactttgccaatggcatgactttctttccgctccagtattacttagacattcctggggcaattctaccgactggtcgggcgatgaacttttggctggtcatcgggatttccgggttgtcatatctcggcctggtgtacatgctgaggcactttaaacgctatttatggcaaaatgtcgccctgattaccatgttcatcgggatcctattgccggctgtcggcgccattatgaacgcgatttcgacgccttccaaccgctgggtcttcctggtaaacatcctgtttgggtttgcaacgatggtctttattgaacatctcagcgattttacgaagcaggatatcgcctggttcggttgggcttcgattggcctgattgtcttagtctgggcatttggcggcttcttaatgaatctccagccccacgatttcatcgtctacgggttcttactgctgacagtgattgtggtgatgggctgtgtcgtctttgattggaaacgctcgactaaagtcatcctggtctcaaccgtcttcatgctgaacttatccgccaacatcattggcatttacagtccgcactccagcaaattagcgctgcagcagctaaaccgcggtctggcaacccgatttagcaacgattactttagtggggctcagaaatacctcaaaaaaatgcccggcttcttcagagtttccatgaatccgcggtatcactacaatacccacattcaaaatttagccaactattcgaataccaatacagatttcccaatcaacagtgggctcaacgacacatcagtctatctgaccctgcagaatggttatctgggtaaattctcacagtccgtcggcaacagccaattttcaatgaacacgccgattgcgcaaggtgattatcgaaccgcctttaacaacctgctgggcgtcaagtacatgtttgccaaagccaacaccaagaatccaccggttgtcccttatggctacaaaccagttcgtgacaagaatggccaaatcaaagtctttcctgctaaggcgcggacggatgccgtccaggcaatcgaaaatatgtatgggacgacaatttataaatccaataacgcactgccgctggtttatacgcagtacaacaccgtttcacccagtgcctatgacaaaatgagtgctgtcgatcgggagcgtgtcatgactcaaggggcggtggtgaatcaatcaaagtataatacccatcccctcaattaccaatcacccaagaaaaacattgattataccgtgaaaatggatacctccaagattgtctataacggccgtcaactcaccaagtatcgacttggcattatcaataaagccaactcggatcagctggtcgaccaaccccacgaacaggtcagcctgggtgccaacctgcaaaagaccaaggacctcttggcaaccaaccgctcgatcatcgagactaaccactacaagaacattaatggcctaaaagagatgacctcagacgttgttggtaatccaatcgactataccttgaaggttaagaaccccaaggccaccaagaacactgaattgttcctggttctctccgggattaagcaaaccgatggtacccctgccgaacacagacagtggatggctaaccagttcctgttggataacaaactctactcgcggatgggcaagatggacgagtatcgtcacagcattttgaagcccacctttggcggttacattttcaatgccttcgctaaagatcatcaaaatgggtataaccaatatgacaacaataatctatccaattaccgtcagatcagtaatatcgtccttaatctgggttactcaactcaccaacgcaagaacattgacctcaacttcaatcaggtcaagaacatcaagttcaagtcggccaagctggttgccatgccgttcaataagacttatgacactcaaatgcaggaactcaagcagactaagcctgccaatttgaaagtcaacggcaatcacgtcagcggcacggccaacaaccagcgctctggcacgatggttacctcgattccatactcaactggctggaaattaaccattgatgggaaaccgacgaagaccttcgttgttaataagggctttgtcggcgccaacctgcctgctggccagcaccagatcaagcttgactatacgacgccaggcattaaagtcggcaagttggtttcaggtatcagctggttggcatttatcatcctgctgggctttgcgatcatcggtaaattcttaccggaacgaaccggtcaacagcacaagccaaaacattgcaagagccagtcaaattgaggttgccaactggtggcccaatcgttaaagttaggataacaaacaaatttttcaaaaatcatttccatctaatctgaggaggtccattgtgagcccaataaaaattctattcatttcaattgagggaaatacgcgttcattcgttaaaaatttaaccagttatgcgactggcatgcacgaccaagatccagccaatccattggtggtctcaaaggaaatcagtgaacagacagattttgctgacgagacggaaccattctttgcttttgtcccaacgtatttggacggcggtaacggcattgacaacggcgttaaagagctgatgaccaatgccttaggggaatacatcgcctacgatgacaatgccaaattgtgtcacggaattgttggcagcggcaataaaaatttcaacgagcagtattgtctgaccgccaagcgttacgcctcacagtttaataaacctttccttgcggactacgaactccgcggaaccggccgggatgttgaacggatttataaattgatggcccaaagctaaacgggttccacaattaaattaacaggaatcaaatgattctgaattaatataaagcaactggttatcctcaccctgagaataatcagttgcttttttatatcatcgtcaaaaaaatccagttagcagctgaactaagccaattgctaactggattgatttctacattatttcgtttcagcgagctgttgccgcgtccgccgtcgattcatcgcccacaaaatgaccacaaagataatgatcaagccggctgctagtgagaacagctctttataggacgcaaagtccagcacaatgccgccaatcagcggtccaactgcccggccgcacgacatgaacaggttatacaagccttggaactttccccgttgttgaggcgtcgataagctgtcaatccacgctggaatcccaggaaagccaatcatctccccaattgtcgtcacgatcatcaccaaaacaaaggcagtataatcgcgggcaaagattaaccacacaaacgatgccgcaaagattgccacccctacgtaggtctgagtactcagtttgaagtgcgtcccaatccgattgacgaacggctgaccgatgacaatcatcaacccgtttaacgtccacagtaaactgtaattttcaaatggaatgtgcaggctggtcatgtgcaccggcaggacactttcccataaggcatacgccagatagactgacaggaccacgccacaaattgccagaatcatcccgccaactttggcttcaactggtgcgcctggcttgactggtttcccaggtgcccgccgatcaacgtgaacattgaattccaaaatcgtgatgaggaccagcacggcataaaaggctgccgtcacggtaaacaccaaggtgaccccatgttttaacaggaagccaaccattaaagtcccaatcacaatcccgacgttttggccaatgtacaagatgttaaagatatcccgtgtcgaacgggtcttgatactggcggcatatgaattcagcagcgtcaaacaagcaccgtcaccaaagccaacgaacagcagcataatcccaaacatcggccagccatggaagaagaccaacgtgacaatggccgtcgttgaaatcagtgaaccgataatcgttgccttgtagggagaccagcgatcaaataaatagccgccaagatagttacccagcatcatacaacacgacatcgccagcaggaccattccggctagcgtcaacgacttatgtaggtagttatgcagatacaccgtcaccagcggccacatgaaagccgccccggcgtttaaaatcagtgaatacacaatgaccgaattaaatctaatttcactccgttgttttatcaattgctcagtcccctcttacactcatttttaaccacaaaatcttctacgtccattttcgcatattaatgacagaaactgtatttattactgaagattatttaaaataattcctttttcagcctaatatcgtcttgatcggtaatctttctcaccacgtgacaaggattgcccactgccagggaattggccggaatatctctggtgaccacactgccggcgccaatcactgatccgttgccgatcgtcaccccaccgatcacggttacgttactggccaaccagcagttgtcctcaattgtgattggcttgctgtactccttgccgggtaaatcattattggcagcaaagtttcggtcctggtagcgcagtggatgcatcggtgtgaccaagctgatattcggcccaaataagacgttgtcgccgatggtaatcatgccggtatccaaaaatgtgatgttggtgttgccgtagaaatgatcaccaatcttgatgtgagtgccataatccacaaagatcggcccctgcagataaattcgttcagatgaattaggcagcagttgcttcaataaatcagcccgcttctcacgttcatcatcaaaggtgtcgttatattgtttgaccagccgatgggccaatcgctgacgcgccaataattcggggtcgcggggattgctcaatttgccggcaagcattcgttgatcttcattcatcattaaggcctccaaacctttgagttacagctatcatagcataggcagagtggaacacgaggcgttttgatcccagaatttaaggcacaaatcgagttattcctgttcttggaatgactcgatttgtgccttaaatggccgggatcagcctcgcgttccacgtttaatcaaggataacagtagaaactcaaaaagaggctggaacataacataaaagcagtcatgtcccagccccgaatcaaatagctggttaaaattatttaactaaagcaaatttgtagtagtgaagcggtgtgttgccatattgaaccttgatcgcatggttggctttgttgacaatgatgaaatgcgtattgtcagtgaatctcaagtagaacttgtggtaagtcttgctgccgcgttcacggtaagtaattccccagaaggtctttgagtaagtcgtaactttgtagttggcgaagttgatcagcttcttttgatacttgccattcttatacaagccttggttcaaaccacccttttggctgaagttggtgacaacgctgtagccattgttgttgcctgattgccaacgaccagttggttctgaaatgttgatcttactgctggttgatttggtgcttgaaccagtcgtggttgttgtcgtggcagtcttaggagtcttaacggtcataattcggtagaagtatgaggttgatgacttccgggcgtagacataaagcttctggttggctttaacactggtgtgcagctcggcactgaacttgccagttgaactgtcagcagtggtgctggcaatggtggttttgttggtgtttcgaacaataatggcaacacctttggtggcagttccagtcactgcctttgaggtcgtgtaaatgttattgactttaagtgacggagaacttgcagaagcgttgacactgaacccaatcaaaaatgatgcgaggacagcaaagaacgcgataaacttaaatttcttcatttgatattgctccctaatctttattttgcatgactcattataaaggatatgggcaaaaaaagccgtcaagtcggccttcatttatccttttcttaagaaaaccgtcactgtttaggcatcgcttttagcgggctaattatgaaaagaatatgcttgtaaattttattcatttacattggcaattcgcttttgttggggtctcatgtgttatataatgttggggaactggtatagacatataccaaattacttagttaatattctgataggagtgaacattttgccaactgaaagacgttctttgattatgctcttcggagcaactggtgaccttgccactcgtaaactttatcccgcaatgttaaagcttttcgagaagggaaacattcgcgatcactttgctgtgattggaacttcccgttacaagttcgatgatgaaaaataccgtgaaatggtcatcaagtctgtttctaaagaatctactaataaaaaacaaattgctgatttcgccagccatttctattttgtgacccatgatgtgactgaccttgaacactattctgtattgaaaaacaaagccaacgagttggacaagaagtatgaattgaacgggaaccgcgtgttctacatttcaatggcacccaacttcttcggaaccgttgctaaaaaccttaaggctcaacaccttctctccgaaggaaacggctttaaccgcttggtcattgaaaagccatttggccgtgatttcgaatcagccaaacagttaaacgacgacctaagcaatgcctttgaagaagaccaaatcttccgaattgaccattacttaggtaaggaaatgatccaaaacatcgaagctattcgtttcggtaacaccattttcgaagccctctggaacaaccgttacatcgacaacattcaagtcacccttgctgagaagctgggtgttgaagagcgtgccggttactacgacaactccggtgcccttcgtgacatggttcaaaaccacatcatgcagattgtcagtttgcttgcgatggaacaaccggttgcgttcaaggatactgatatccgtgctgaaaaagtcaaagcattgcgtagcctgcgggtttacaacgttgccgaagcatcaagcaactttgtccgtggtcaatacgctgccgttggtaacgataaagaataccgtgaagaagacggtgttccaaaggattccaacactgaaacctttgttgccggcaagttgttattcgataactaccgttggtcaggcacaccgttctacattagaaccggtaagaaactcgctgacaagttcacccgagttgatgttgtcttcaagaagccattagttgacatcttcgccttcccacaaagcggcagtgcaccactgagtgccaacgttttgactatcttcatcgaaccaaaccaaggcttctcattgatggttaacgccaagaactccgaacaaggattccacactgaacccgttcagttgcagtaccttgaagattcaaagcgcacccgcgaaacaccacaaccttacgaacgcttaatccacgacgttttgaagggcgacggtaccaacttcgccagctggccagaagttgccagtgcttggaagtttgttgatcaaatccgtcgagtttgggatattcaacaaccaatgttccctaactacattccaggatcaatgggcccagtttcagctgatgaattgcttgcccgcgatcaccgtgaatgggtatacaaattgaataagtaacatctaaccaatttagctgaccgaaaaccaattcgttttcggtcagctttttgtttgggttaacgtttgaaataaattgtaaatttttaccattttgctgaaagtccatggatccagatttacatttttcaagcaacaaaatccctcaatgattgaaaatcggtcattttgaattatgtaagcgctccccacaaaacgacttttcattttcacaatctctcatctaacaaattcggcatactgttccaacgcgtttttgtttcactttccacttgtgagatggtacactaattgtgtagtaattcttatatagaaaaggatggttttgaaatggctgatcaaaaagcaaacattggtgttgttggtatggctgttatgggtaagaacttagcccttaacatcgaaagccgcggttacactgttggcattttcaacagaaccggctccaagactgaagcagttatgaaggatcatggagacaagaaactagttccaagttacaagattgaagactttgttaaatcacttgaaacgcctcgtcgaattattttaatggttaaggctggtaaaccaaccgatgctgttattgatgaattactgccactcctcgataaaggcgatgtcctgatcgatggtggtaacacaaacttccacgatacgatggctcgaaatgcccgtcttgataaatcaggaatcaactttatcggcatgggtgtctcaggtggtgaacttggtgccttacaaggaccatcattgatgccaggcggccaaaaagaagcttatgatttggtagaaccaattctcaagcaaatcgctgccaaggcacctgctgacggcgaaccatgtgttacttacattggaccaaatggtgccggacactacgttaagatggtgcacaacggtatcgaatatggtgatgaagagttaattgatgaaagttacaacattttaagaaaccttgccggctactcagttgatgaattggctgacatctttaaagattggaacaaaggtgaactcgacagctacttaatcgaaattaccgccgacattttgactcataaggatgatattggtgctgacaagaccaagccaatcgttgacatgattcttgaccgtggtgccaacaaaggaactggtaagtggagctcacaagatgccctcgaagtcggtgttgaccaatcagtgatcaccgaagccgtttacgctcgttatatctcaatgatcaagaacgaacgtgtcgcagcatccaaagtcctccctaagccggaaggcaaagttgattttgataagaaagaaatcgttgaaaaagttcgtgaagccctctacttcggtaaagttatgagttatgcccagggctttgctcaattaaaggctgcttcagaacaatacaagtgggatatccaattaggcgaaatggccaagatttggagagccggctgcattattcgtgcccgattccttcaaaacattaccgacgcctacgacaagaacccagatttgcaaaacctgctgctggatccatacttcacggatatcgccaagaagtatcaagaatcagcacgtgacgtcgtagcattggcaaccaaggccggcgtcccagtaccatcattagccgccgctgtctcatactacgactcatatcgttcagaagttgtcccagcaaacttgctccaagcacaacgtgactacttcggtgcccacacctatgagcgtgtcgaccgtccagggagtttccattatacttggtatgaagaacaatagagtgccctttaagccggttagcttttgagcattaatggaataacaggtgttgatgcgctttttgcatcaatgcctgttattttattaagcggagaaagctggcttaaatggcacgtttccactatgtagaagtcgagaacacactactcaacctgttggaagaacagtagtgagcgacgaaacccgggttgaccccggaacataagtcagaaaaatcatggatgaacgcttcttgttcatccatgatttttttggcttatgtggtaggggtcagggttgtcggagctgtcctcaaaggcagccaaatctgaaaaataaccataaatgccaatcaagcttttgagcattaatttaacaaggaccgttaacgctgtttttacgttaacggtccttattggactaagcgggaattccgactctttacaaaaagagctagcactaacacaccagctcttggtatttcacttaattggcagccacaatgtcgaccgccaaggtacataagcgtttacgaagtttatcaggaacttgaccaatgatcgcgccgttacgggcaacataatcataattgggtgtttgccaagtcacaatatagccattggtacgactacttgggtcaagaatcggttcgaatcccttttgaatttgactagtgccgtgcgtgataggcatcacgacaacaaatcctgtcaaccgattatattgggcgttcgataccaccactgctggtcgtcgcaggtggctagtcgtatgtccgcccatttcatgcccagtgtgggggtcaaaatctaaaacaataatatcgccttgttcaggaaaggatgtactcataattcccgacctttccttgactcgtttccaacattgaaaccaatctcgtcaatctggctacgaaaatcaacattgtcatatgcgcccgatatccacgggtttttatggctgtgggcgcgccggataatcaaagtatcttcatccactttttcaattaccaccggctcgttgctcgaaaatcctgtgcttttaggcaaggttacgctgaccgaattgccagttttatgcgtttttgtgtttgcaatttttaagttattcatgatcaattcctccctaaaatttgagctaagtatatcgtaattacaatgttattacaagtacttaccttggtaaatacccatcctttaagatgagctgatcttgatatttgagcatcaaatttgttcactcaagcactcagataacatacccactcaatcactgtcaaattaacaccaaatccctttccaggattcaaattcaaaatcccattaataaaaattgctcgcaatcatattaaaatactatatttattgttataataattatagataggaaaacagttatagagtgagggctcttgaattgactgtttccaagtagacatgatggccaacttggctcacaccattgacaaggatgccgtcagcaaagcacttcagtgtgctcaaatcaattttgaaaatagattatttcaatgcttcgacataatattcatgcctatatcgttatacataaccaacaggggggtgatgataacgcattactttttgacgtcgcagattgatgagaacacatctgcgatcgaaattgcggagattcaacgattacatttgttttcgaaactcaaggttcctgccaagattgtgacccgcaatcgcaatcgtggtagtaatcgggtgttacagcagctaatcgacaatcatcaaatcattaacctctaccaatactttactgagcttcccaaccaaaccgagccgatgcccaaagctgaagatgtgttgcacgatttcaccaacattccgattgaaaataatctgggatataaggacggcaagctccgggttcgggtcaatgaacagaatggctggatcaataacatcgattatttggacccgttcggcttcaccgaccgtcgcgacctgtacgacttcaatcagcgggtgtcttcagaatactttgacgatcatgcaaaattaatcacgcgggtattctatcaaaaagatgggcacatcgtcatgactgaatactatcggggtggccctggcaaccagccggtgctgacactgattcacttacggcataacggccggctctggcagttcgataatcaagatgagttaatgggctactttcttgactgcctggcaacagacgattccaacgccacgttttatagtgaccgcgaggacgttgccatccccgcatttaaattgatgaccaagcccgccaaacgctatctcattttgcattctatttttacgcaaaatgccaagcacgatggtgagctatttccatatttccagcaagcaattgaactaaaggacaagttatccggcatcatcgtttccactcagcaggaagccagtgacattcagtcgcggttcccgatggttcaaacgaccgttattccggtcagttaccttgacgaccagctgattcatcagtcggaatcatttagcgaccggattcccggcaaagtgattgctgtcgcgcggatcacgccgttaaaacagctgagccacattattcaagccattatcttagttcatcaacacctgcccttcgttactctggatatttatgggtacgaaaatgtcaatgattttcaggaaggcaacaagctgcgccaactcgtcaaaacatctggggctgagagctatatcactttcaaaggctacgttcacgatttggcgtcagtctatcagcacgcggacttgttaaccctgaccagttcatatgaggggtttgcaatggcgatcttagaagcccttggttacgggtgcccggtccttagctacgatatcaattacgggccggcagaaatgattcaagacaagcataacggggaactaatcacagccggcgatgaacgcgaactttatcgccgactgctgcacctgttgacacaccgagagatccttcaacgatacggtcaaaatgcgccggcgtctgttgagaagtattcggcaagccatgtgcagcagatgtggcacaactttattcaaaatcaatgaatgacaaactaattgaacaattcaattaagttcatttctacaaaatacattattcgaggggaaataataccatgacaaaattaaatcgaaccaattcaaaggttcattacaaaatgtataaggccgggaaacattggctgtacgcttcactactcaccgttggcttgatggccggcggtgcgtttggtgccagcacagtcgaagccgataccagcgataatcaggcaccggcaccaactacgacagctgcgactactcaaccgagtgccgatacgcaaaccgctgcccaaaccagttcagctgacagctcgacagccacaacggataatagccagactccagctcagtcacagaacactgcagcgacgaccacttctgattctaaccaagcaagtggtgcaaccaccacgactcctgacgctaatcaaacaagtggtgcaaccactccagcaacgacggcagatgatcagggaactgatcaagcaccgactgcggatcctgcaacaacggagacgaataactcgacccagacgactgggactgatcaagagagtaatcaacccgcaacgactacgaatacgactaatgatccatctacaaccggcactgacaatgatgccaccacgactgacccatcgaaccagacaagcgaccaacctgatcaaaatgcggctgacgaccagaacaaagcctctgacccaaccacaaccgatgatcagaacacggccactactgaaaacactgatgcaactgctgattccgcaaagacagccactaccgcggaccccactgcttcatcggcaacagccgatcagactgcttcgttagccaagacacccattgatacccagtcactggcggacccaaattccagtgatttttgggaacaggtctttcaactagcgactattattccacaagccattgccggcgcagtcatttcggcacctgcaattcttggtggtgggacaatatccttgtatccgattaactcctcatcggaaccgatcgtgattcctggacgagttcttcagttcttaactggtggactgtggtcttccccttgggatatttggaatgccttgaaggatgggttggggcttaatagcagctcaaccactaccaccgcccctgtaactagtcctaatcaaagtgaaacgacaaacttagcgaccgcgagtgtttccggccaacctatagattttggtgatacgattggcgagtttattgattccatggtggccaccattcttggggaactgcagtacccaatactttctgacgtccctggaatcattctgtgggttactccatccacgcctaatcagccaactgaaccaaaccaaccaactcagccgaaccagccgacgcaaccgaaccagccaactcagccgaaccagccgacacaacctaaccaaccaactcagcctaatcagccaacgcaacctaatcaaccaacgcaacctaatcagccaacgcaaccaaataagccaaataagccaaataagccaaataagccaaataagccaaataaaccaaatcggcctaatcagccgaataagccaaataaaccaaatcgaccgaatcagccgaataagccaaataaaccgacacaacctaatcgaccaaatacgccgaataaaccaagtcggccaaatcagcctaaccagccaaccaagtcgactcactccaattggccgactaagccaaatcattcaacgggaaccactactaaccgcacatcgcggaattcccgagatataactggcaagacaccaattgaaaaagcatccgtcttaccacaaactggtgataagcgacaaaattggctcagtattctgggtgacgtttcattggccgtcattatcatttccggcgccatgattttcaaacggcgtaagcgtgattaattaattttgaataaatcacgtaagttctacatttcataaatcttcagatgcttaaaatggcccatggccaaattccgatcatgattgttctcacgaacatcatgttaccgggatttggccatgggccattctttgtctaaatggttatttaacgggtcaacaattaaccaaacgctagccctgctcgccagccttaatcttcttaccaaaagcagtttcatcaaaatgatcgatcacgttttgaagatccgccttggttaagctagcgccaaacagctcactgccgggctccgtcatgatgccgtcagcaatgttgtaataaaccacggtgtcaaagcccatgctgtcgacaaattcagccacttgatcaacggctgcttggttatcgccggtcacaaacaacgctttgcgattgtctgctccagctggtttggcctcttcctgcaggttgtgatagcccatgtggttaaatgttttcaccacggtactcttattgaaatactgctgaacctgttcactggaagtcgacgatggatccaaaacttcttctcgaatcccgtcagtttcccaccagtagttcatggcatcgatcaccaatttgccctttaagagcttggatttgatgttcttgtagcggctcagtggaatcgctaagataatcagatcacttttggcaacaaccccttgattggtcgccggaactgcacccggtaccaaagtctcgatggtcatggcaattttttcgaccgatccggaaccggaaattcgcacgtggtagccagcctttaacgctaactgagctaatacgatacctacttttccggcacccaggatgcccacatttttaatttcagccatgcttagccctcctcagacaaaatttctttgacgcgaggaatcaccttagtcgcgtacagctcaatcatgcgttcacgctgggcagccgtctggttgccggcaccgtaaaccaagtcaaatcgacccaggttcatcaggttgatggtgcgggccattcgttgggcgacgtgttccggattaccgacgtaaaatgagccgaccttggtttcaccgtcaaattgttcccgactcatcggggcccagccgcgagttaaaccgatgcggtcgaagttggccttgatattcttccaagcaacttcaacggcctgatcctcatcgtcagcaataaagccatgagagtgaacggcaacgggttgaaccggcatattgtatttttcggcagctttcttgtacaaattcaaatacggcacaaaacgatccgcctggccgccgataatcgccaagatgaccttgtaaccataccgggcagtccgaataattgattcgggtgagccgccgataccgatgtaagtttcaatgccgttataatcggtctttggatagacatcctgatccttcaaggattgggtaaatttgccatcccaagtaatcggcttttccttaatcagttggctgtacatctctaatttttcattgaataaatcatcatagtcggttaaatcataaccaaagagtggaaatgattccgtgaaggatccccggccaagcatcacttgagcgcggccttgagataagccttcaagcgtggcaaaccgttcatagactctgaccggatcatcagagcttagcacagtcaccgcggtcgccagcttgatgcggtcagtcactgaagcaagtgcgcccaggacaatttcaggacttgagacactgtaatcgggccggtgatgttcgccgatcccaaagacatcgacgcccagcttgtcagccagctcgccttccttcacgatttggcgaatggattggccagccgtcaacagctcgccgtcttctccccgaacgatatcgccaaacgtttcgaggccaaattgtaatttgtctacatcaaccatgctcatgctttttcctcccgttgcttactttttgtaagtatgataatagattatagtaatttgggggaaattgcaactaaaatagctggggaattggcttcaaaagtctaaaggcagaaattaggactcgcacaataacaggcaaggctgaaagttagttcaaatcatattcaaactgttggaaaaaggattgaagccgccattgaataaattaattcatactgaagctgtcctaaagtagtgaatggattgaaacgataagctagaaacagataagaatgtcgatagcgggatgactatcccgcggtaagacgtggttatctgtttgtagctgtttcaagcaactgtcctaaagtagtgagcggattgaaacgataatctacaaagagataagaatgtcgatcgcgggatgactatctcgcggtaagacgtggttatctgtttgtagctgtttcaggagctatcctaacccaaaaatgcagaaacaaactgttatccaaaatgaaaaagaagcctattaggaggtaaaacataaacctaataaacttcaatttagtttcattttttataatcatgtttggctaaattatgatttagtgaaagaaaaaaccaaattatgagtgtcaggactagccaacagccaatcgctacagctaagatagatccaagtaatgtagcccgatttgaggattacacaaaattagtaattagcccattcaagattggtcgatgtgttaatagatcaattggaatggccaaaacatctagtgccaacataattccaataaatgatgcactctcaagcatagctctttttaacataaataactcccccttgaaaattagtgtagcatacaccatttgggttgaacagctaagatttataacaaaatagggaatatgatatacttttcctagaaatgacagcgttgaattcacattttattaaaaagtattcaaaaatgcgtaaaggagcactaaacaatgacttggctaacaatatatataatagtgatgggattggttgccctgtatgtgtgcttcaatttagtacgtgctattaaacgagatggtttctttaatctcatagttttgatctggtttctagtcttaattgtggttgtgatcgcgaccctgggggttgtgtcgattatgacggtaacgatgcaaccataagttgtttgagaacctaagttgatttcatttttttgaaatttgaatgattattcttaacattacataaaaccttggcttatataatttcttgttgatctattttttgctacactaaaggaaattgcattttaaggagatttcgcataatgaaaattttggtcgttgatgatgataaagaaattgttgaactcctcgatatttatattaaaaatgaaggttatgagccagtttctgcatttaatggaaaagaagcacttacaaagctgcatacagatccagaaattggactaatgattttggatgttatgatgcctgaaatgagtggaattgaggttgtccgtgaagttcggcgtgattctcaattacccattctgattttgtctgccaaaacagaagatatggataaaatcaaaggattgctgaccggtgcggatgattatgttacaaaaccatttaatccattggaggttatggcgcgggttaaatcgctcttgcgtcgtagccaaaatgatttgaaacaagatgaaccggaagttttggacattggcccgttaacaataaatagtgattctcatgaagtgaagactttaacgggtaaatcagtccagttaactgcactggagtttggtattttataccttttggcaagtcatcctaatcgtgtcttttcagcagatgatatttttgagcgggtttggcagcaagaaagcatcatttctgcaaaaaccgttatggttcacgtgagccatttacgtgacaaaattgaagaagcaactggtggcgaaaaggttatcgaaactgtttggggcgtcggatataaaattgagtctcactagagtgaatttgtgaggtcatttcgatttagtcgctttagcgatgtagtgagaatgggaatcgaaacgaggaaaagttttgaaattaactgcacgagaaaaaagtgaattattaggtgaaggaattgttaccgttattttgttactccttttaaatctatccatcttggttttggccactgaaattattcgaagtaatcctggattggaaagtggtatttttcaaatcaaggagtcaattacgataggtcccaataattatcgggtttggagttatcaaaacttctttattttcttcatggccattgtagacgtttgggtcgtctattggcgtttaatgcggcgatataaacagatgcagttgcgccatattattggtgaattacactatattgccgatggtcactttgatcatcgcattccttttacactgaaaggtgatcatcaacgcgttgttgacagtgtaaatgtcttagtggattcggtcattgaatcgatgaatgaagaacgaaaaattgagcagtcaaaagatgagttaatcacaaatgtgagccatgatttaaggacgccactaacctctattattggctatttgggattgatcgaaaaccaacagtacaagaatgaagatgacgtgttgaagtacacccatacagcattcttaaaggctgagcagatgaaatctttggttgaagatctttttgaatataccaaagtgcgtcaagcttcgactaaaatgacatttaaccaaatttcagttgaaccgatgttggagcagttagctgctagttttgaattggaagctgaaaaaaagggtatggaaattgatgccaaagccacacccaaaaacattaaaattgaaggcgattcagaaaagctagggagattgtttaacaatttaatttcgaatgctttgaagtacgctaagggtggtaaacatatcaatttggaagccacacaaaaaggcgatcaaattatctttaaggtgtccaatgatggcgaacagattccagaaaaatcgctaaagcacttatttgagcgtttttacagagtggagtcgtcacgatcaaaggcaacgggcggtaccggattgggcctggcaattgcgcagagcattgtggaattgcatcacggaaagattagtgtgacatctagtgagaaattaactagttttaaggtggaattgccggtgacacaaaaaagtactaaggatgcaaattaataagtttctataattcaggaaaaacgaaaaccattcgcgtaaaattggtttccaaacaaattatatttttgctttggctagctggtttgcgattggattttcgctttttttgtgaaaaataaaaaaggtttacgcaaagtgcgtattttgttatattcttgttataaaaggtggcaaattaatgttaaaaaaatggcaacaaaaactagcaattattttcagtacaattttaatgctgagtacattagcaatggcaccaatacaggcccaagcggccactgtttcagtttcagccaagtcaggaatagcagttgatgccaaaacaggacagattttgtatgctaaaaatagctcaaaggcccttccgattgcgtcaatgtcaaaaatgctgtcaatttatcttgtcttaaaaagtattcatgaaggtaaattaaagtggaatcaacgggttcatattaatgccaatattgaaaaaattagtaaagatactgaactgactaatgtcccattgagtacatcccgtacttacaccgtgcgcgatctttacaaagcgtcattaatttattcagcgaatgcggccgtaatggcgctggggattgcccaagccggatcgtcaaaagcattcgttaatgagatgcgggcacaagccaaaaaatggggaatcacagacgctaaactttataatgcatctgggctgacagaaagtgaagttggtaaagaagcgtatccaaatacagctaaaaacgatgaaaatgaaatgtcggcaaaagatgtggcgattgtggcatcaaatttgttaaaggattacccagaagttcttaaaaccacgaaacaaacaagtgcttggtttgccaagggaaccactgatgcagtgaagatgaccacccataactacttattaccgcatatggcggattatctaaaaggatataatgtggatgggcttaaatcgggaacttcaactaaagcgatggcctgttttaccgggaccgtcaaaaagaatgggcatcggattattacagttgtcatgggatcaagctcgaaaaacgaaggaaatgctcgttttacagacacccaaacgattatgaaagatgtctataacaacttcaaaccggtcagttataaaaaagggacggccttaaagcaagcatcgacttttaaagtcccggaaggcaaaacgaccaccgtcaaggctggattacaacaaccgacaactgtttggattgctaaaaaccaatcaactaaaacgattagttttcgtagcaaacaagctgaaagcaaagcaggactatctgcgccagtgaaaaaaggacaaaaagttggtaaggcaactgtcaaggtagctaatcaaaaagtgaactatctccaaagctccgatgctgagttacagttgactaccaaaaaatctgttgaaaaagccaatgtgttagttcgtttctggcgatctatcgtcagtgtcttttaagaaggtctagctaatgaatgaaattcaatttaaagtggcgacaaaagcagatttaccttttatcgtggctatttacaatcaaactattccgagtcatgtagtgacagcatccctcgtaccagtgacggtcgaacaacgcttgccgtggcttgaagcccataaatcaactgaacatcccatttgggtagtttggctaaatggcaagcgtgcggggtgggtaagcttgtcaccctatcacccgcgggctgcataccatattacgtcagaaattagcatttatatcgaccgtcaatttcagcatttaggtctgggaaccaaaatggtgaaatatgctgaacttgctgctccaaaactgggaattaagaacattgtttgtttaatatttggggcaaatttaccaagtttagggctgtttgaaaaactgggttatgaaacctggggaactttgccaaaggttgcagagttggatggccgtttaatggatttgaaaattctcggaaaaagcattcagctagtttcaaactagtttcatttaatagctttcgatttagcctgaaagtcttaaaaaggcactattcaatatactttgaaaatgttaaaatgatttcgcagtgttttctatgaatttcagtattgatgatccaactttaaagatccgttggaggaaagaattgtgaaacaacttgaaaatggaccacaatggcgggtaactctcaaagaggcttggccgttgtgccttagttacacaccaattggactggcctgtgggatcctcttacatgcggctggatttaatacgattttaactgggctggtttctatttttgtattctcgggtggtgcgcagtttatgatcgcccaaatgcttacaacaacagctccaattctgacaattattttgatgctttttttcctggaattacgttatgcgttgctgggatctagtttagctagttatttaaaaggtcaaaatcatcgctttttatttttatttgctgtttcaatgaatgatgaaaactatgccattaattatttaaagtttgtgactgatcgtaactggacaccaaaagatgcccttcaggtagaacattggtctttgttagtatggaccgtgtctaatatcattggcagtttaattgggagtgctgttcagattaatttgacggttgttaattttgcattgacagcgttgttcttgtatatgattgtgatgcaaattaaaacccgcttgattttattgatctcagttgttgctggggttttggcagccttttttatgttgttgacaaagagtactctcggtttggttatttctactttagtggcatcattcttagggtttatgattgaaggatatgtatctaaacgttggcctaatagtcatttgttgtataaaattcatgatccatcagggcaaccagaagtcgataaggaagatatcgaaatctaattcagacgaatttcgggagattgtaatatgcattatagtgtaactgaccacttgctaatcgttattttaggtttttttgtggcgtttggtcctcgatatataccgattttattcttttcaaatcgaaaaataccagactggtttaatgactggatgaaatacgttccggtctctttgtttacggcaattgttgtgaaagatatttttatttcgggatcctatcatttcatttcttctgggaacttagacttgattctggcttcgattattgtcattattatttcttactggacgcgatcgatggctatttcggtagtttttggcttaattgccgtgatgttattatccatgttaatttaaatctaaaaaagaatcagactagtgcaaggggttgttgtaataatctctcttgagttaagctggttctttttgttttgttccattttgtttcgctcactataactatgacaggttcacaagtcagcctttagaagataagcaagattccaacgggattgcgatcccgcctccatctcacttatcttctaaaagctaccgacttgttccgctcactattaggacagctcctgaagacagcccaaacaagataaccacgactcccagaggattgcgatcctctatctgtcgtggttatcttgtttgggctaaacgtcttcattcgctcactataaaacaaaggactgagaataagtctgactcccacgggattacgatcccgtctccgtcgcccttattctcagtcctttaccgttttgttccgctcactacttatacatatacgctcttgtcattggcaacacattgctgcttgctcctgcaccctttgttaacaaatactggatcacatcaatgttacctgattcgaatgatgccgaacaagcttgtaagtacaaatcccacattctcacaaaccgttcgtcaaacatctttacaatttcatcacgatgttcgttgaaattcttatcccaaatttctgttgtcttttgataatgacgacgcaatggctccatatcatcaatttgcatgtcattttcaataatatggtgaatgttttcttccaaacctggcacatagccacctgggaaaatccatttgttcaaccaaccattgttcgcaccaccctgctggcgcgtgattccgtgaatcaaagcgacgccatcttttttcaagtaatcagaaacacacttgaagtaagtctgtaggttttctttaccaacatgctcaaacatgccaacactggttatgtagtcaaactgctcatctttaatttcacgatagtcttgtaaacggacctcagccacgttttccaatccttcatccttaatacgctggttaactaaattaaattgttcctgagaaagagttacaccaacaacccgcaagtcatattcctttgcagcagttagcatcaaagttccccagccacaaccaatgtccaataaagtacgacgaggttgtggattcaacttattcaaaatatggtgaactttgttaacttgcgctgtttcaagatcgtccgtatctttctcgaaataggcacaagaataagtcattgttggatctaaccatagcttataaaaatcatttccaatatcataatgatcttgaacatccgatttgctttccttttcgtcatgcttttgtttaggaagaaaatggataaactttttattgtggaagaaactgccagctgtttcgtatgcagacgtcaataaagcctgaatactaccgtcaatttcaattttgccatccatataagcctcaccaagtgcaatagaggcattgttgatgatttgcttaacaggtacagcttcgttcaaagtaatggtgacttctggtgtgccatcaccgtatacctcagaactgccatcccagtagtttactttgaggggaatattgaaggagtgcttaaaaaacgttttgtaaaattttttctctaacatcgattagaatcctttctcttatgaataacaagattaaataagattattatacgctccctagattgatttttcgaattttaagaataatgtcaaacggaaaatcaattttaaagtagataacatgctataattattttatatattggctttgtagggatcagtagaattgggggcggctcgtttgagaaaatggacatgggtaatcgtcacatttattgtgattttaatggtggggggctatgctttctcacgacaccaatcaattgaaaaacagtaccacgtagatatggaaaacgcagcggctgcaattaatgacgaaaactattcagcagctgaaacgtattttcaggcagctttgacgcggagaaataatgattcagtagcgacacatcgattgcgacaaactaaggtatttgtcacggcaatgtcgcaattagaaaatcatcgtttctcaacatccaaaaaaacatttgcacaagtttataaaattcatcatgggtcaaaagtcctgaacttgcgtgctcatgaaaaaattactgaaatcggtaaggttcaaaagaacattactaaatacaataaagttataaaatatgcgcgtgagttgaacgaggcccaagagttcagtttgtcgaatgtgcagttagatagcttgtttaacacaaaagaatttaagaagggttactatacgtcgctgtggaagacggctaagcagattcaaaagagcaataagactggcttgtcgcaggctgtaatgccaggatcaacttcaagttcggcacaaagtccttccagtaataacagttcagcagataacactacgacgggagctacatctggttctagtaatagcaacggtgtttcctcgttaccagcacctaacctgagttcttcggaaaaacaggctgctgataactattctggcagtaacgaatatacggttaccaaaaaagatacagaattaaacggcaaagtgattacacaggcgcaaattaatgcggctcgtcaagaacttggcacgaagtcaaaccaattcagtgatcaggatattcgaaatatcattaaagaagcggcccaaaagggcatttcagttagtgaagctgcccagtaaactcgtcaaaaggtttaatattttcaaacgtttgaattgagactgcaaattattctgttttagtgtaaaatgggtattgtaaacttaaaaaagaaagaggttttctcacattatggcaaaattagtattaatccgtcatggtcaaagtgaatggaacttgtctaaccaatttactggctgggtcgatgttgacttaagcgaaaagggtgttgaacaagcaaagaacgctggtaagttaatcaaagcacaaggcattgaattcgactatgctttcacttcagtattaactcgtgcaatcaagactttgcactatgctttggaagaatccgaccaactttggattccagaagttaagagctggcgcttaaacgaacgtcattacggtgctttacaaggccaaaacaaggctaaagcagctgaaaaatggggcgacgaacaggttcatatctggcgtcgttcatacgacgtattgcctccattgttggatgcagacgctgaaggttcagcagcaaaagaccgtcgttacgctaacttggatccacgcatgattcctggtggtgaaaatcttaaagttactttggaacgtgttattcctttctgggaagacgaaattgctcctaagttattagatggcaagaacgttatcattgctgcacatggtaactcattgcgtgctttaagtaagtatatcgaaaacatttcagacgaagatattatgaatcttgaaatggcaactggcgaaccagttgtttacgacttcaacgacaaacttgaagttcaaaacaaacaaaaattagactaatttagtcgtttaataggcattctccctcagggggtggatgcctattttttataaaaataattgactaacttatatggcgttcacttcaaggcagaaaatgatttcggtttttttattaagtttattttttgtgtttctgttttgttaatgtataaaagaagtaactaagcgttgctatcaaaatgaatccctgtaaaaaaaagttccatggagttggtagcgtgatagtgggaccaataattaataagttattcactaacagaatcaagccaacacataataagaagaggatagctatcgatattttaggaagaacggattggaaaaaactagcagattttgaataaactgacttatgcaatattttgagaattaaactgattgtaataagttcaagaaatggagccagaatgaatgcccataggtttatgataattcctgacgtagtactagtgctacttaacaaaagaaaaaaccaactaatggcaatgactagagtactcattgacaattgatcacgtaattttggcttaggcaactgtgctaagatttcatttgccatactttgaggatcgttaccaaacaattcagtcgcatctgaattatctttttcagcatcaattagatcctgtaacatgcttaataactgtaagttaattgtttcgtcattgtaaaagatgttttgactcaaaatataggtttgtaacttttcaaaatatcttgaatcagatgagttaagctgtgtttttagctgattaatctcctgctggtactgatttgcttttttcattattcatcatccatctcttttaaaattttgtcgacatgattttttaattgaaaccactgctgattaaattctcgaaattcttgtagtccttgaggtgtaattgaatagtatttacgatcaggcccatcctttgagggtttcactttgctgattaaggcaccgtttttttcgagttttatcaataaaggataaagagtaccaccagcaattgttgtaaagccgtgttgatgtaaagattgaattaattcgtaaccataaacttcatcttgagcaacaattgctaaaacacagccttctaacacacctttaattaattgtgtttgcttcattttttcacttccatataggttgctttactacatagatatagtgtagcaaagtgaaactaggttgtaaagcaacttagttcctggctaagcggaccctttcataggttatcatgttgtttatttaactccgaaattagtaagattgaaaatggtataattattacaattataaaggtttatcgcaattcagctaattttacggacttaaccattgataattttgttaatgtattatttgtctagttgcggtaaattataaacaaggaaaaactaatttgcacagcgcctaattacataaaaagcaaataacaacatatctggaggaaaaatgaaacaaaaagtagaaaaggcgccaacattgcgacgttcaatgaccgcaaatcaaatggaaatgatttctctgggtggtgcaattggagtgggcctctttatgggggcaacctctacaattaaatggacgggtccttctgtcatttttgcctatatgtttgtagggctcattctctacattgtcatgcgcgcccttggggaaatggtttatgtcaatccagggaccggctcctttgccgattatgcaactgagtatgtccatccacttgccggttacatggcaaaatgggcaaacgtttttgaatatattgtggttgggatgtctgaggttgtcgccgcaaccgagtacttaaaatattggtggccgcacactaattcatttattgcaggaattattgtgattttattcctagttgcagccaatctcactagcgcaaaggcctatgggtcactggaattttggtttgccatgattaaagttgtgacaattattatgatgattatattgggatttgccattatctttcttggctgggaaaacggtggtcacccagtggggttgagtaacctttggagccacggcgggttctttaccggtggttttcgtggatttttcttctccatgtcgattattgtgggttcttatcaaggaattgaactacttggaatttcagctggtgaagtggcaaatcctcaaaaagcgattgtgaaatctgtgaaatctgtgctgctccgaattttaatcttctatgttggggcaatttttgtaattgtaacgatctacccatggaatcaactgagttcgattggttcgccattcgtgtcgaccttcgccaaggttggtattacaacggcggcttctgtgatcaactttgtggttttgacagcggcactctcgggtgccaattcagggatttattcttcgagtcggatgctgtttaaactagctcatgaaggggatgcacccaagatcctaggtcggttgtctaaacgagttgtacctgatgcagccattttaggaatctcgggtggaattttacttggctttatcgttgatacagtggcttcaatctacagtaaatctacttcaaatttatttgttgtggtgttcagttcttcagtgctgccgggaatggtaccatggtttgtgattctgttggccgaactacgcttccgcaagggcaatgcgaaacttatggagacgcacccctttaaacttccgctttatccgtttgccaattattttgcattcataatgttgttggttattgtggtgttcatgtttatcaatccagatacgcgaatatcagtgatcgttggagcagtagttttgattctggctgcgacggtttacttgatccgtcatcgccagaaaatctaaatactaaaagacggcttttaagaccgtctttttttgttaatttttttcgattcccagttcaatgatccccgccttttccattaagcggatactttcttccaggtgatggactaaagatttttgatcgttgctatcaagtaaggcgactcgactttcgatctgagactgaatcaaatccatatgggccttaacaactgattgacccttttttgtgcgttgaacattaatgattcggcgattatcctcgtttcgttttcggtgcactagcccacgtttttcaagtgtattaataatgcgggtcaattgtggtcgagtgatgccgatcgcgattgccagttcagtcatggtcatgccggagtgacggtaaacatttctgagcgtgatggcttgcaatctagtgagttcgaaatcttcgagagaccgattttgtgagattacttgtgcgaaggccaaaaacagtttgccaaacgcatcgccactattagtatttgtttccataatttgcgtctccaaagttggtataaaaataagttttcataacagttgacaattgtgaagtatgtccctatagttaagcattgtcaaataaaatcagtcaaaattaaaagtaaaaagaggatatgccgttgttaaatttaagccacatcaacaagtattatcacgttggagatactgttacaaaggcacaagatgatgtttctgttgagtttcgaaaacaagagtttgttgctatattagggcccagtggttcgggtaaaacaaccatgctgaatatcattggcggattggaccgctatgattctggggatctgctgataaagggcaagtctaccaaaaattttaaagactctgaatgggatgcttaccgaaataattcggttggctttatttttcaatcctataacctaatttcccatctttccattcttgaaaatgtggaaatggggatgactttaagtggtgtgccatcagcaatcaaaaagcaaaaagctacagacgctctaattcgggttgggctaaaagatcaaattcgtaaacaaccaaatcagttatccggtgggcaaatgcagcgagtggctattgcccgagcgattgccaatgatccagaaattcttcttgctgatgaaccaacaggagccttagattccgaaacaagtgacgagattatgcaattgattcgagatttgagtaaagatcgtcttgtgattatggtgacgcataatcccgacttggctcataaatatgcagatcgcattattgagtttgccgatggtcagattcaaaatgactcaaagccgtttgaagaagaacaagcacaaactgatttttcattaaataacacaaaaatgagctactggacagcgcttatgctgtcttacaccaatattcgcacaaaaaaaggtagaacgttcttaactgtgttcgcttcaagtattggtattatcagtattgcagtcgttttggccctttcaaacgggtttcaaaaacaagttgatgaaagtcaaagtgatgctttgtcaacaatgcccgtgacggtttcaccaactagtacggatcccagtgccatgagttcaagtgataatactgataaaaagctttctaagaataatcaggttaaggctgaaaaaagtgctgaggataaagcgcaacacacaaataaaattaccaccaattacttggattatttgaataaaatgcctaaaaaagatgcgaaaaacattgctgtgagttacggtaccggcatgaatttattgcggaaggttaatggtaaatacaaaccagttacattttcgactagcaatccggacaattcctcaaccagtgcgagtgcgatgatgagcgcgtctactggcttaaatggaagtgtttatccagttgaccgtaatggcaagcaaagtttcttaaggacgtattataaggtgattgctggcagttatccaacgaagtctacagatattgtgttagtggtggacaaagataataccgtcaatattaatgccctaaagaatcttggttttactgttaaagaaggtcaaaagtttaattataaagatctagttggcacaaaaattaaggtcgttgcaaatgataattattatacaaaactgccaaccggaaactatgtatctggaacggattatgcgaagatggccgcaaaggcaagtacaaaaacgctaactgttaaggggattattcgggtaaaagcctcaggtaactcggatggcattcttgcaaatggggtggcctacagtgctaatttgacgaaagacgttttgaatgcaaacaagaattcaaaaattgtgactgcccaaaagaagagcaacaacaatgttatgactggtcaaaagatggacaatgcaacccgttcagcaatgttgaccacacttggtggtgactcaacaccaactaatattcaaatttatccaactaagtttaaacaaaaagacaaggtcctttcttatttagataaatataataaaggtaagagtaaaacagataaagtcgtttacacggatcttgccagcaccatttctaaaatgaccggtggcattatggacgccattacctatgttttggtggcttttgctggaatttcactggtgacttctatgatcatgattgcgatcattacgtacacaagtgttctagaacggactaaagaaattggggtgctcaaagccttgggagcgcgtaagaaagatattacccgggtgtttgatgcggaaacctttatcttagggtttggtgctggggtgttcgggattttcgttgcttgggcgttaactttcccgatcaacgcgattttggagaatgtgactggactagcgggggttgctgttttgaatccgacccaagctgttatcttagtgattgtctcaaccattctgaccatgttaggtggtcatataccagcacgaatggctgccaagaaagatgctgccattgcgttgcgagcagactaaatttaaaatatgcaaaagaaagtgcaaaaaagacggttcagacgatagtcattcttgtggcggaagaatcttccttttttacacatttcagaaataatattttggaaaatataaagcgggcaggcaaaaacatagtttttgcctgcccactttttgtctgcttcggataatccgaaaaaatttaccgttccttgaaggaccttgacagaagagaattcagcatgtatagttagtcacataagtaactaactaattcactatatatggaggggcaaaatggcaaatattttagaagtcaaacatctaaacaaaagttttggacggaaaccggttttacatgatattagtttcacagtccaaaaaggccgaattgtagggcttgtaggacctaatggggcaggaaaatcaaccattatgaaaactgttttaggattgactgatttttctaatggtgaaattttggttgagggacaaacggtcacagccacaaagcatactagtttagcatacgtgggggcgttaatcgagtatccagggatttatccatttatgagcgggctggatcatttgaagttgtttgcaacgggtgatgatcaaaatcaacgaattgatgaagttgtcacggagttacgaatgacaaagtatatcaaacggaaagccaaatcctattccttgggcatgaaacaaaaattaggaattgctttggccttagtgaaccatccaaattttgtggtgttagacgaaccgatgaatgggttggatccggaatcaaataaagatttgcgaaatattataactaacctggctaaaaagggaacaactattttaatttcgagtcatattttaagcgaactcgaaaaattggtgaatgacgttttagtcattgataaaggccgcattgtttctcaatcctctatgcggaatttgatgaatcgaggcaaaaagtatctcgtgatcaaatcagctgatgatgcgaaagccaaaaacttgttgatggcggccggctacgaattggcagacggtgatgacgttcgaattttagaaacagatgcacagaaattgatgccaattttaaaaatctatgttgaaaatgatattgaaattttagatattcaacatcagcaaagtgacttagaaacatcattgttaacgctgctggctaatgatcaagtgacggaatagggggagaagcaaaatgttaacgttaatacatcaagagactttcaaattaatgcataaaaagagcacttattttgtttcactgtttttggcaggcatgatcatcttgtttggagttcttgctaagttgtatcctaatagttttgatcccaaaagtatgtttaatattaatttcacggggattgaatggatcacgtttttaatgattgcggcaagtgcttcaattgtggcaatggaatttcaatacggaacggtaaaagaactgctgtatcgaaagtacaatcggggtcaggttcttgtaagcaaatggattgtcacttttatttattcactctacatgtacgttttggcactggtgttaacgctcgtgttgaaagtggttttgtttaatcatacctttgagctgggcaaactcagtggtagccatacagttatcgaaaatttactaatttcaatgggaagccaatttattggtttgtggttggtgctaagtttggtcttgctcttggcaactatgtttaagagctcaacagtagcagtttctgctggatttatcggctattttgctgccaatattgcagcaagtttgatgttcggacttattggcaaatgggagtggttaaagtggaatccattaaatatgctgtcattatcaacgcaggtcatgacgccatcttatcgtgagtttactaagctgacggttgatcaattggttatgggtaatcttggttacatcgtggtatttttgtttttgggttatcttattttcaaaaaacgaaatgtgtaattaaataatctaaagtaaagccgtttcaggtctcagaaaaataatgagccgaaacggcttttttatgtggcaaactgtaatatttcacctcttgaattaaagaaatgtaatataatgacactattggatagtttttgatatgactggaggggtaacggcttgcaaatcagaaaaatagtgacgagcttaggagtcttatttctagcatcctttttgactgcatgtggggcaaaaaatacaaaagttgttgttccaaagaaaaattcaagtacatttgtcattcaatcgtttctaatttagttttatctttatgaaaagaattttaaccattgataaaagctgtccacaaaaatttactcatgtttgactggagattgttttcagtagtgcctactgtaatggcttttatattaaaaaagttatgaataaattatataattttgatgcgcgaaggagtctgttttactacgcattcagtaatagtgaatggaatcttgattgggtaaaacgagtcttatgaatttttttggtactaaataagcgtcataactgttcaaagcaaggttaaccatttttcttgtagcagtgaaacgtttatttaattttgtttgtaaataaagctagtggaaataaacttaaatacggctaaactactattgacatgaaatgctttattgcctaataatgggcttattatctgtaactttatagggttatgtacataataaatattaatgacggagaatacatatgaagaggcttatttcaaaaggaattgatcaaattattttgtgtctactaatcattagtctggttggggcattgatctctacaaatttagcgaatacctatcaatttggatttattgtgggtatattaactattttgggtattatactagtaattttaccctttccgaaggctaacataggaaagtatttatgctttttgaatcaaccatggtttttttgcttgattattttggcctatcaaatcctattggttgtcagtttaacgggagagattggctatgatgcgtttaccattaagcatgcagctatgggaaatccagattattattacttttccgtttatccaaataatctgggaattctatttttaatgcgctttttatatgtgattagtcatgcccttgggataacgaattttacacttacattgaatttcgttaatatattttttgttgatattgctgtatttttaatttggctttttttgaaaaaatatttaaaaaagtcgattttatggggtttgtttccttttgtattcacacttgcaccatggctggtagttttttattctgatacaacagttttaccgttcacggccgcaatgattgtgacgctgtatgagttacttcaaaactttaatcataaacaatactcagcaaaaagattatatgtgttgagtaccatttttggtattagcacattttgtgcatatgcgctaaaaccaagtacattcatatttgtgctcgctaccgttgttgaattggccttgaatttattaattaagcctttctccaatgagtgtgggggacaaaattttggtcctgataagccacttcaatttgtttgtaacgggtagttggacgttctcctaataaagacagacagccttccttagtggaataggcgtctgtttttttcgtaattatagggtttaccattggaactggcaatagtcccatttgaaaaacaatgatgcgtttgttcacaccaatcatgttggccgccatcccaacacaatcagcttgatgcgccttgagagtgtctaataaatcagttgtcacttgagcatctgctttggtagctttaactgccttttgtgatagtgacgctgtgttgcgattgatgggtttaatcatggttttgctccttaaatgtttggttgcttggaaagtacaactctttatttttatgattgagataatcggtaaaaatggccgaaacaaccgaatttagcttatagtttttcatttgattccgtgccaaccacaatgtttgaccttcattttttgttccggctaggttatgtgttgcagtttctgtgggaattgttgcttgatatacaaagatgagttctttgagactgtcttgacggtcgaaattaacaaagcccattagtgtgggagacacaatggtcaaaccagtttcttctttaatctctcgaatggccgcgcttgtgacggattcgttgggttccacatgaccaccaggaaatgttagtgatggttcgaattcggaatcattttttttcataacaagtattttttgattacagttaattaaacaaatacaagtaagttcacaaggatatgttcgatccatgaggctagcttcctctctatattaaaattcttttttacttattttatcatgttgaatgaagaggcgtgatattgattgttagcgttattgcagtagatgcaagggttcaaatccctaatgacgatgtgtttaaaaggattaaagctttttatatttagatggaggaaccctctgaaagacggttataaatgctaagtacgcttccagcaggtttacgatcccacataaagcacacttagctttttataactagtattttattcatttatttttccacttgacaattcattttatcaagattagaattgcattaaaatcaaattaataaatgaacaatgaaaagatgagtagtcatgcgattgacttttagagaggttccgtttggtgaaaggaactacaatcaagtggtgaagatggtcttggagagaaatgttgttgaatcattgactagacaacattgggtacgcccattaacgcgcagagtatagcaattttattgtcgtactttttaagttgtttagtgtgaactaaacaaaaacaaaaggtggtaccgcgagatcaatcgtccttggaatttattccaggggcgttttttattgttcaaataataaataggagagtgtatgagatgacagttagtgtaaagaatcaatttccatatcgttatgacgaagtaggcagtttgttgcggccagaagctttgaaagaggctcgggccaaatttcatgctaataaaattagcacggatgagttgaaaaaggttgaagaccaagaaattgaccggattgttaaaaaacaagttgagcttggtttaaaggcggtaactgctggtgagttccgtcgtagctggtggcacttggactttatcgatggtctaaatggtgcccatttcttcacacctgaaaaggggtataattttaatggtcttgaaacccgtaaaggtggcatcaagatcacagataaggtgacttacaaccctgatcatcctttctttgcggatttctcatacctaaatagtattgtgccagaaggcgtgactgctaaacaaacgattccaagcccatctgttttgtttcctaataaggatgcagaaatttttgatgactattatgactatgatttggacgactttgtggacgatttgattgttgcctaccaaaaaacggttcagcatttttatgatttaggttgtcgttacctacaaattgatgatacctcatggggaatgtgggccagtttttcaaagggcacgctgaatcctgacttaaaacccgttgcgaaagcagctgttcgtgcaatcaacgccattgctgataacaaaccagtagatttaaccttgacgatgcatgtgtgtcgcggaaattatgcttcaacatgggcaggggcaggggcttacgatccagtggccgactacttagcacaactccatattgatggttatttcttggaatatgatgacgaacgctctggtggctttgaacctcttaagaagattgccgataatggccgtcatcaacgcattgtgttaggcttggttacttctaagaaaccagagcttgaaccacaggctgttttgaaagcacgaattaaggacgctagccaatatgtacctttggaagatctttgcttatcagcacagtgtggctttgcctcaactgaagagggtaaccacttgaccgaagaccagcaatgggacaagttgaaacttgtgatcgacacggctaaatcggtgtggtcagattaaatttagaaaagtgacttcagtttcgactatgataaataagttaagtcacaaaaatgaggtaaggggaaattcccaaacctcatttttgtatagtttagtaaagatatgctggtccccagtactttacagcattatgggcaattccttcatacaaagttgttaaagcatgtggtgccacgtattgatgagcaagtaaataatgtgtaatttcacgactgagttttacgcaaactagtttgacttcagcattattttctaattcagttgcataagttaagagaaactttgaaatttctgtattttgtttgatttctggatctttgtaggcctcatcaattaaattaaaaattgctttttgttttttgtccatttcctgctcccccaatgttgtgaatcacatatggtatacaccttgttagatcagtttcaagtcgaccattctgttaagatgaattttgatattttgatattttgaaaattggttttgctgtatttgcaacaaaatgctataatgttttttattaagcgaggtgatttccaatggccgatgttttacgcgaaattggcgcaatttcaagagcactcgattcgattagtaatattgagtttaaaaagtatgagttaaccaaaggacagtacctttacttggtgcgcatttgtgaaaatcccggtattattcaagaacgagtagctgaaatgcttaaagtggatcggactaccgcggctcgagccattcagaaattaacgcaaaatgggttaattgaaaaacgaatgggcgtcactaataagaaaaataaacagctctttccaacatcaaaaggactggcaattttccccgttattcaaagggaaaacaagtattcaactagggtggctttgaatgggtttacggatgaagaacggcaattagttgaacgattattaacccgaatgcgcgaaaacgtttcgtcagattggaattatgttaaaaaaggaaatcagcggaggtactgaaatgataaaacaagtgcaactgacaaaattagacgtcaatgattggcaagaattacaaaaagtgagtatcgaaacttataaggatacgtttgatcctttcaacccgcctgatattatggacgcttatttgacggaggcgtatgaaccgaaaaaattgcagcgggagttagcaaatcctaattctagtttttactttgtgaaggtcgatcaagaaacagccgggtacttaaaagtaaatataaatgatgcgcaaaccgaaaaaatgggaactgataatttggaagtagaaagaatttatattcgtccagcttttaaacaccagggattaggtacccgcctcattcaagaagcggaaaaactaactcgtgaaaatcataaggccaaaatttggttgggcgtttgggaacataacgaaccggctaaacatttctacgccaagtttgggttcaaacgcattggccaacattccttttttatgggcgatgatgaacagacagattatttgatgcaaaaggtgctttaactacaaaaggttcgattctagacataagaattggcctttttttatatgcaattgtctctccaaatagaagagaaaatccagtgtggccctcaatgaaaacgctttataatgggttttgtttgtttatgccaaaatttggtggtagggtttacttggatggcactttaaattagttagtggaggagggtaactttcgaaacagaatactgatttgaggatgacattttttattttattaaggagtgatttgtttgcatcagagaacacgtaacttacgtcatacaaccagcgtaatcacaattggtggtttgttatttggttatgacacaggtgtgattaacggtgcgttgccatttatgtcaagtagatcgcagctaaatttaaatgcgacaggtcaaggtttagtatccagtattttaattttaggtgccgctttaggttccatgtttactggaaaagtttcggcactttatgggcgccatcgtgtggtccaatggattgccagcttatttattctcgctaatgtattttgtgcgttggcaccgaacgaatttatttttattatttttcggtttgttttgggaattgccgtcggggcggcatccgaagtaattcctgtttatctctcggaaatttcaccgattaatgcccgggggatggttgttacccgtaacgatttcaaaattgtgttggggcaatttttcgcttatgccgttaatgccattattggtgggacgtttagcaatattatgtggatttggcgtgtcatgttagtcatggcgtccttaccggctgcaattttgttgttggaggatcgttccgttccggaaagccctatttggttatggaagaatggctattttaaaagagctaaattggtcatgcagagatatttgcaacccaaggaagctaagcaagaagttgaagaacttcaaactgatgacgattcagttactccagcacaaacttggcgaaacgtcttattttcgagtaatatcaagattttattaataggggttggactagcaattgctcagcagatcacgggggtcaatgccattatgtattacggtaccttaatgttagaaaaaactgggttaacacgaagttcgtcactttatggaaacatcatcattggattagtatctgtgttgagtgtgggtatcagtgtccgaattgttggacgattcaaacgccgtcatttattgttggcggggttaattggtagttcggtaattttagccgctttgagtttagtaactcgtttactgacaggcttagggctagtcataacagttctggcttttatcacgttatttttaatttgtcagcaaggacttatcagtccgctaacttggttaattttgtcagaactatttccgattgatattcgtgatgttggaatgagtttttcaacgttttttgtttggatggcggactttgcagttagtttcatctatccaattttgatgagtgcgttaggattgtccgcagttttccgaatttttgcgggttgtggcgttctttgtctcatatttgtttacttggtcgtacctgaaaccaaaaatagaacgatggtcacatctaatcaagtgaataattaaacggaaagtattcaagctttaaaataggagtgaattattgtgaaaccagtagaaacagcaaccaaggatgtccctcaaggtgacattcacggctatgatcagattctgaaatattttaatagtgagcctgtgaaacagacaaaaaaggatgcgtatcattcaattacgtttgtcacgaccggaattattgcttatgacggcggtcaaacaacaatgctacatttaggaacattgcttagtcaacagggatacgatgtttattatctaagttatgtgccgcaaacttgtaaagagatggctcaaaacgctgaattcaactatgccggttatgaaggtacttgtttggacatgagtcagttagattcacataagtcggatatctggctcgcaactttgtgggagtcagcgtatgtgattaaaaataaaccaggttacaaaatgtattttgtgcaagattatgagccttatttttatccttatggtgatcgttatcaaatggccaaaagaagttatgaattaggactgcatatggtttcgttggggccatggtgcgcaaaaatgattaaggagaattgtactgtgacaagtccaattgatcagattaattttccggtcaacttggaacagtatccttatcaatctcgtgattttagtcattatcagaataaaagtagctttgatgtggccgtgtatactaagtggagcagtccaagacgagcaccaattaatattcagttgagtttgaagaattgtcaggcaattttagctaaacatgatatgaaattgaatttacattattttggtactgataaagccgcaaagtttattaatggagaaaatcttggcaaactaaccaaaactgagatgattgatttgtatcatcgttgtgattttggcattgctccatcaatgacaaacttctcgttagtaccttttgaaatgatgagttgtgggcttccattgatcgattttaaagaaggaacaggaaaatatttcttgccagaaggttcttatttacagactagttttgatgaaaaatatttggcccagacttttttaaacgccagattgaatagttttgtaattgaaaaacgagtgaaaaagggcgtttctcatttaaagtccattacgtggaaacagacgcttacagattttgaggcaattatcgaaaagatttcgatcgcagttgcataaaaaatgaaaaaagaagagaagaccgcaacaaaaacatagtgtttttcgtagtctctcttctttttttgaatattttttactcttcttgatgtcacatctatttatttagttgtggcctccaaaattttagttttcggcgaaacctgattattcagcaccttaaatttcaggagagaaatggcatccatattggtgatgattaccatcatgggggtctgtttgccggcatctttaatggcttgtaaatcaacgttagcaactaaatcaccatgattgatgtgttgaccatcactaacttttacatcaaaaggtttaccttttaattcgactgtatcaattcccatgtgaaggaggatctccagaccagaatcagttgtaaaaccaatggcgtgtttggttggaaagacggtggtaaccgtcccatcaactggagaggtaatggtgccagatgtgggttcaatggcaaatccatcacctaacattttttgcgagaatgttgaatcattgacatcttcaatattcatatacgtgccatcagcaacactgtaaaactcatttaatacaccagatttgatagcagaatccgacgttgtttcagcaggagattgggtcttagtcgttgcttcttcttcaagttctgcaagcggcgttttggcgttaaacagtttgcttaaagcatcggctacaaactgaacttcagttccaataatgatgtggaggtttactttatcaagcttatttaagcccacagctccactgcgcttgatggcagcctcatcgattttatccgtatctttcagttgtaaacgtaaacgagttgtacagttatccacagcagttaaattatcagcaccgcctagggccacataaatttttttcgcttgaatactgaatttatcgtctttatcatcggtttgaatagttgcctggggagcatcaccgtcatcagtgtcagttaatggttctcgtccaggagtcattaagttaaacttttggatggcaaaattaaatccaaagtagtaaatggcagccatcactaatccttgcggaatcagcattaacggatggtttgcaattggattttttaaactcagcacataatcgattaaaccagcactgaatgaaaaaccggctgtccagtgcatgaaggcggcaaatgccattgataagcccatgaagaaggcgtgaatgacgtataacggccaagctacaaacatgaaggagaactcaagaggttcagtaacaccggtgaaaaatgaagcaaaggcgcctgctagcatcaaggaaccaacttcttgtttgcgttcaggacgcgcgtttcgataaatggcgtaggctccagctggtaacccgaacatcataacagggaagaaaccagcttggtacattccggtaacacctttcggaccttcatgagctaagaacttaccaatatcattgatcccggctacgttaaataggaagacagagttcaaagcttgatgaagaccagttggaatcagcaagcggttgaagaatccgtaaataccagctcctagagggcctaagccgacgacaaattttccgaaaatgaccaaagcgttgtaaagcggtggccaaatgacaagcaggacagcactgacaattaacatgacgagcgccgccataattgggactaaccgtttgccactaaagaaggaaagcgccattggcaatttggtgttgtggaatcgattatacaaggccgcggcaattaaaccggacataattccgatgaaaacattgctgattgctgcaaatgacggatccactgccgaaactttagtgccaagcaaggtcgccacggaactagacttcaaaacatttgtgggaacttcaaatgcaactagtccagctaaagctgcggagccatccttatccttagccatccctaatgctgtcccgacagcgaagagtagtggcaattgatttaaaattgcattaccaccagcttgtaaaaaccgggcaataaaaccactatctgcggatgcccaccaaaagccgacgccgacaagtagtgctgccgccggtaagacggccacgggaagctgtaaagaacgacctaacctctgaaaatatgttttcattatgaaaacctcctgaaaaatagaatgaaatttacaaataatttcatttattagtctaggttacagaaaacaataatgcaagtggttatgttacatgatctcacatgtatcagcatttatttgattttttttgaaattggtttacctatgaatgacgatgaaaaaatgccgattaatgaaataaatgttgaaattgttatgtaaaacaggctttattttttgtaaaagtttgacagcggatacattcactgctaatatagaaacattgtcacaatgttattacttcgggtaagcatgtgtgatagtagatttgttaaattaaatatcataaggtgttatcaaaattttgagcatgacttatttgttggagggattttttcgctgcaatgaataagtctttttaggtggtccgattgaaaataaaacgcgttttaaacaataatacagcaatttcagagaaccatgacggtctagacattttgttaatgggtcctggaattgcgtttggtaagaaaaagggacaagaggttgagattgaaaaagtagaaaagacttttattattaaagatccggatacaatgaacaaatttacggacttagtcattgatgtgccgttgaacgagattatgattgcggaaaagattattaattttgccaagatcaaattaggtaaacagttaaatgaaattatttatgtgaatttaacagaccatttgcatacgacgattcaaagatatcgtgatcatattattctcaagaatcctttaaaatgggatgtggcgcgtttttatccagacgagtttgcggtcggtcaaaaacttgttgaagttgtgaaaaatgaacttgggatcacgctagaagatgatgaaagtgcctttgttgctttgcatttcgtgaatgcagaaacagagtccggggctgaacaaaatttggcctatggcgtcacaaacatggttaaagaagtcgaagatattgtaaaggactattatcatactgagtttgatgaaagttctttaaactactatcgtttcatcacgcatttaaagtttttttgcccagcgcgtccttttaaataagcactacgatgacgatgatgaagatttgcttcgtaccttggaaaagaagtatgccggtccgtatgaatgttcacggaagatccaaacatttattcaggaaaaatataactatgaaattagcagtacggaattattatatttgacggttcacattagccgtcttgttaaaaacttatagggtgttatcttagttgagcatgacctaagtagcttatttggctatttgggtctttttttatggaaagaaaggaagaaattaattatggattatgcaggttcagccaaacagatttttgaggcagtgggtggcgaaaagaatattaattcgttgattcattgtatgacacggctacgttttcgtttaaaggatgaaagtattgtagatgatgaggcagttaaaaatatcccaggtgtcatgggtgttaatcatcaatctggtcaatatcaggttattatcggtaacgatgtgacaaactactacaatgaaattttgaaactaggcaaaattgatacaggtgatgcggaccaaacacctgatcagggagaagaaaaacaaaaagttaatttgtttaaccggttcgccaattttatttcatcatgtatgtcaccgttaattccagccttaattggtggtgggatgatcaaggttatcttgattttattgccgcttttagggtggttgaatgaaaaaggacaaacctatgcaattttaaacatctttggggatgcgccattttatttcttgccggtcatgttagcttatacagctgccaagtactttaaagttacgccaatgttggcaatcacgattgccggtgttatgattcatccgaacttcacagcaatggttacagcaggtaaagcggttcattttatggatttacctgttacattggttaattattcatcatcagttattccaattttgttagtagtttgggcaatgaagtatattgagatgggaattgataaagtttgcccagcctcattaaagagtattctgaaaccactgttagttttgtttgtgacaggtactttagcacttgttttgatcggaccaatcggaacatatgcgggtaaattattatcctttatcattttatttatccaaggaaaagcaggctggcttgcgatggctttgatggcggcctttatgccgctgattgttatgactgggatgcattgggcctttgcaccaatcttcttagctgcttccgttgcttcaccagatactttgattcttccagcaatgttggctgctaatattgcgcaaagtgcggcatgttttgccgtcgtatttatgaccaagaatcgaaacacacgtcagattgcgagtgctgccggaatttctgctttgctagctggagtaactgaacctgctttatatggtgtgactttgaagtataagaaaccattatacgcagctatgatttcaggtggagttaccggattgtttatgggaattgtcaacttgaagtcgtttgcgtttgctgtgccttcattgatttcgttaccacagtttgttagcaagacagatagtagcaacttaattaatgcaatcattgtactagttgtttcgtttgtactgacctttattttgacatttgtttttggaatcgacgaaaaaccagttaaagcagctgctatgtcggaagacgagccagcagttaaaacaacggtgccttctggtgccaaagaaactaaaaaagtttacagtccagttaaaggtgaaatgattaacttagagagtgtttctgacgatacctttgctcaaaaaatgttgggtgatggcgttgctattatcccagaagaaggtaaaatttatgcgccatttgatggccagattatgaccgtcttcccaacgaaacatgcgattggtttaaagagtgatacaggaattgaattgttgatccacattggattggacactgttaatttaaagggtgtgccatttacagctcatgtgaaagacaacgatcaggttaaaaagggtcagcttctgatggatgttgatttagatgccattaagaaggcggggtatgacattacaaccccagttattgtcactaatacaaaagattttgttgaaattgtatcgaatgaaaaaacgacagttactaatgatgatgttgctttatatattatttaaggaggaaatggactatgagtagttttccgaaaaactttatgtggggtggcgcgacagccgctaaccagttagaaggcgcttatcaagcaggcggcaagggtttatcaattgccgatgctttgcctggtggacccgaccgttttaaattggttaatgctcctgattttgattggacaattgatgaaagtcagcatacttatccaaatcatgacgggattgatcattaccaccgtttcaaagaagatatcgcgctatttgcagaaatgggcttcaaatgttaccgattctcaattgcttggacgcgtatctttccaaatggtgatgaaaaacagccaaatgaagctggactgaaattttatgatcaagtaattgagacttgtcagaaatacgatattgagccggttattacgatttcgcattatgaaatgcctttaaaccttgtgaaaaaatatggtggttggaaaaatcgtcagttaattaccttttacgaacggtttgcgcggacagtgctggctcgctactataagcaagttaaatactggatgacgtttaacgaaatcaacagtgcctttaatttccctgtcatgggccaaggattagttgcctctaatggtgccgatgataagcagaatatctatcaggcttggcataatcagtttgtggcaggtgcaaaagccgtcaaaatcggtcatgacttggatcctgatctaaaagtcggttgtatggttctttatgccacaacttattcctatgatgcaaatccagttaatcaattagctacactagaacaaaatcaagccttcaatcatttctgtggcgatgttcaagtacgtggagaatatccagcctatacggaaaaactgatgaacaagtttggtttcagtttttccgatctggaaattggtgatgaagatttagcaactttaaaggacaatccagttgactatattgggttcagttattacatgtccaccacggttgatgtggctgataagaatcgtgaacaggcttccgggaacttaattgggggcgtgaaaaatccgttcttaaagacaagtgactggggctggcaagtagatccaatcggtttacgaattgctttgaacgaactatataaccgttatcgcaagccattgtttgttgtggaaaacggtttgggtgcggttgataaaccagatgaccagttccatgtacaagatgattaccgaattgattatttgcgtgaacacatcaaagcaatggctggcgcgattacagatggtgtggatctcatgggatatacgccatggggatgcattgatctagttagtgcttcaactggtcagatgtctaaacgctatggatttatttacgttgatttagatgatcagggaaacgggacattgaaccgctacaaaaaggcttcttttgattggtatagagaggttatcaagagcaacggtgaaaatttaggctaaaggtagtcaaaattgaataataaaggccttctaaatataaagcaatttatttttggagggtttttaatttttcacctttctgtattgaaaaaagctaggaatattcatttttaatcaggcactatctcaaatgttgtgtgacgcatctaaaacactaaagataggtgctaactatccactggtttatacaataattttagagatttgtagcaaattatgtagttttcaaaataaaactgtttgaattttctacataattcggtatactagttaaggagtctttttgattctttcacgaatatatcgtttgcttgtttagctcagttggtagagcatcgctctagtaaagcggaggtcgctggttcaagtccagtaacaagcatcgttgaacactcacacacatgtgggtgtttttttgtgttttcgttaagacaaacagtttttgtgagattagtgatttgaatggatcttaatcattaaattaaaatctaattataaaaacgagcgttttgtgactgatagatcatatttgtagcttttgaacaaaaaagtaaattatggttctgaatattcaagtctatattcaataggatttgcatacctaattattttgggtgatctagataaaattagaagacaatcataattttctcattgacagcatagaaaacggtggtatgattaaaaacgtattaaatcgaaacaaacgagataccgtgataagaagagtagcacaattagtatgtttatagagaccgcgagttggtgaaagcgtggatcagaaggttgtgtgaagatgaacttggagtaaattaacagtggaagctattaattcgtgatgaggcccgttaatgcctcaaacttttggtaacagaagttattgaggtggaatatgcgagtatttcacaaattaaggtggtaacacgaaaatcgtccttcagaaatgagggacgatttttttatattctagaggggatggttgttatgaatcgaaaaataaaatcggttgtagtagttttagggttgttaattttaagtggttgtggaagtcaagcaacggcaggaagcaacaccaaactggctaaaaatcaggtgttgaattgggcagaaagttcagagctggcaacggcagacttatcacaggcgacggacactttaagtttcaatacgttaatgaatactcaagagggactttatcgtttaaacagtaaaggaacacctaagggagcgctagcggcaaagactaaggttacaaatggcggtaaaacttacacatttacattacgtaaaggcgcaaaatggtctaatggagatgctgtaacggctcaagattttgtttattcttggcggcgaacagttaatcctaagacagcctctcaagatgcattttatttctaccaagttaaaaatgcagaagccatcaataatggcaaaaaatcggttaagacactcggaattcaggcaacaggtaaatataaattgacagtgtcactgacaaaaccagtttcatattttaaaaagcttttagcttggccgttattctatcctttgaatcaaacgatagttaataaatacggtaagaagtttggaactcaggcaaagtacacggtttctgacggtcctttcaagttggctaactggaatggacaaagtaagaagtggacgttggttaagaacaataaatattgggataaaaaagcagttcatttaactaagatcaatgagcttgttacggaaagtaccacgacgagttacaacttatttaatgctaaacaaacagatgaaacattgcttagtggtcaacaagtaaaaaataataaaaacaatgcagattttgtgaaacgtttgccaactgcaacggcacgcttggagttaaatcaaaacaaggtaaaggccttcaagaatgttaacgttcgccgcgcattctcacttgcaattaatcgtaagcaactgacaaatgacgttttacaagatggctcagagccccttaagggatttgtaccatctggaatgggaaataaccccaaaactggtgaatcatttgataaagaagcatatgtaaaatcagcagttagttctgatttagcaaaagcaaaacagttattgaagaagggctaccaacaaactggtgtaaagaatatcaaagtaactttattaacttcagacacagatagtagtaaacaaactgctgaattccttcaaactgaattagaccggttgccaaatgtgaaggtgtcaatttcaacgattccgtttgtccaactcatttctaaacagaatgagaaaaactatgaagcgacgattcaaacctggcaatcagtttttgctgacccaattaatttcttggatgtttatgaatcaggctcgagctacaatacatcgggatacaaaaacaaaacgtttgataagttattggacgaatcagaaaacgactatggcaaccagccagagaaaaggtgggctaaattggtcgcggctgaaaagttattgatgagcgatcaaggcacgattccgctgtatcaagttgctaagtctcagctgctacgttcaaacgttaagagcgttgtttataatcctgccggcgttccttatgactggaaaacaacatatatcacaaaataagggatgaaagaaatgagtgaaatcaatcaagattatattgaaaagttattcgtaaaatatgcaaaagtaaataccagatcagatgatcgcagccaaacggttcccacaacgccgggacaagtcgcgctagctaaactggtcacagctgatttgaagaaattgggcgtagcaaaagttaaatttgatgaaaccaatggctatgtgacggggactttgccaagtaattccgacaaaccaatcagtgcgttgggcttcattgcccatttggataccgccgatttttcagcgaaccatgtaaagccacaggtgcaccccaattacgatggccaggatatcgtgttaaatgaagctaaacaaattgtattgaaagctagtgaatttcccaacttgaaaaagtttgtgggtcagcgtttgatcacttcagacgggacaactttattgggcgccgatgataaagccggcgttgcggcgctattcggcgcactagactatttcattcaaaatccaactgtagcgcacggaccaattcgggttgcgtttggaccagatgaagaaatcgggcggggtgctaaacagtttgatgccaaaggctttggaactgattttgcgtatacactagacaatggtcagccgggtcaatttgaatatgaaacttttaatgcctctgaagccaaaattgaggtcgaagggaccgccgttcatccgggagatgcctatggactgatggtgaatgccgtgacaattgcaaatgagattgtgagtgcattgcctaaagatgaggttccggaaaagagtcgggatcacgatggttttatcttagttaatcattttgaaggggcagtggcgcatgccagcctgaatttaattttgcgtgattttgatacgcctcgctttcatcaaaaagaagctttgcttaaacgcatcgtagccaaaattaatgaccgttttgtggagccgcgagtcactttagagttgactgaacagtatcaaaatattggcgatgaaatttgaaaaaatccctacattgttaatttagctttggatgcttatcgccgaatcggattaacaccggatattcagccgtttcgtggtggaactgatggtaatgccatcactgcaaaagggattccaacaccaaatttatttaatggcggggataattttcatggtccttacgaatttgttaccacagaagcaatgggagtcgtcgctgaaacaatcgttgcaattgcacgggaacatgtccgtcagtttggacaccatgacgtaaaaccactttaagttaataatttttgaaatagctattcattgggaatggctatttttattgttcagatgattaaaacttaccctgacgatcttttaagaaaaacttaagataaaacagtaactaaaagcttataaagtttcaaaaatattatctggggagataatcatatgagaaaatggcgtaaactttttgcccaggcactgattgctagtgctgggattttagtggcgttaagtggcgcaacaacttcggtttttgcgaatgctgacggtacgacaaatgttaaaaatgacaaggtaactgtcaatccagctcacggggtgacaacgaactctattcaaggagttgacatctcgagtttacaagctgaactgaatgccggcgttaagttctatggttacaatggtaagaaacaagatattcttcagactttggaagactcaggtgtaaactatgtccgtcttcgaatctggaacgatccatatgatagtaaaggtcatacatatggtggtggggatgcaactttagctaatgaagtaaaaacagctaaagatgcaacggctcatcatatgaaggttctaattgatctacagtattctgacttttgggcagatccagcaaaacaagcacttccaaaagcttggaaaaactacacgtttgctcaaaagaagacggcagtttacaactatactaaaaaagttgtgacaaccatgaaaaaggccggtgtagacatcggtatggtgcaggttggtaacgaaacaactaaaggtatgatgcaagaatcagatcctgctaaatacatgcagtacattgctgaaggggttaatgccgttcataagtatgcaccaggtgctttggcagctgttcattatgagtctccttctgagtcttcctttgccaaaatcgccgctgaattaaaagctaataaggttaattatgatgtcatgggcgcaacttactatccacattggaatggtcctgatagcaaattaattggcgctgaaaaggttattactaagacatataagaaaaaatttgccgttatggaaatgagctatccatacacaacagatgatatggatggacaaaataatattgtgggtgacattacaaacccaccattcccaatctcagttcaagggcaatctgacgcgattagtgacgtttggaagacagtgatgcaaaatggttacggcaaggctttgggtgcgttttattgggaaccagcctggattcctgtcaaagctggttgggataattaccaatacaaccgagatatcagtgtgaaatatggcactggttgggcaactcaatacgctgctaaatattacggtgatgctggttatagtgatcaagaggaaaatgttaattcgtactggggagcttcctcatatgataatcaagctctgtttgatcctcatggctatccattacagtctttgttaaccttcaagaaaatgattacgaactatgtttctgggagtgctaaaaagcccgtagatcgatacaaagttgctaaaaaggcctatgcttacacttttaatggtacaagcgacaattttactttcaaaaaagctttcgcccttagttctttgaaaggctattataagattaataaggctgagtatgtaattaaaagaaatggaaaaacgtatttgtactatcacattacttcaggcaaaaagtctggttggatctggcattcctatcttaagaaatgtccaaataagatcactaaaactgtcaaagtaagttacaagcatcgctatgttgttaagaataaaaaaggcagtgtttatggtttccaaggtagttcaaacgattttcaatatgtaactcttcattatttgaagaattatcctaagactcactttactgtgacacgtaagacttatgtcaaaaaatacaatggcaagacatacttgtactactatgttcattccggaaacggaaaagttcatggttatgtatggaatggctatttaaagtaaattagattcgataacttctttgatcgctaacaacgattagagaagttatttttggtttaaaaactactttcgactaggattaatataaattgtggtattgtataaacgtaataaataaatggagatgatgaaatgagtaccgttttagttattaaggctcatcctgcaaccgaagatgtttctaattctttggtcatcggagatcattttgttgaaacttatcggcaagcacaccccgaagatcagattattgggcatgatttatatgctgaaggcgtgccggaaattaacagcagcaatttagacagctggaagaaactcaccaatggtgttacttatcaggagctttcagaaaacgagcagatcttattaagccgtcaacaacagcttcaagaacaattcattcaagccgataaatacgtctttattagtccaatgtataatctgtttttgccgaatcgtttaaaaatgtatttggatctggtcattgtttctaccaaaacatgggtggaaggtgcgcatggcccagaaggaaccttgcatgataaaaaagctattcatatccaatcctcaggcggaacatatcatcattcggataatgcctttatggcaactctcgatatgggggatgcttacctaaaagcgttacttggccaagtaggtgtcaaggattatcaaggtatttattgtgaaggtaattcacatcgagaccctgatgatatggcagccaatcgagaaacaattgctaaagaagccgaaaaggttgccaaagagttttaaatagaaaaaatgctgatcaaaagttgaccagcatttttattttcttaaattttaaagatacgtgtcagttaattttctttagggagaaaccaaaatgttttggataaagagacattcgttgtgcacgataactccaatcgccactactaaagccagttcgattgacgtcaaacacaatctgtttagttttacggttgatttctacaaattcacttcttgtgccgctatccgcatagccaaagttgataagactatttcctttaccaattgcgtagttactgccgacaatattggtgaaatccgatgtgccacgtgactttccgtaaccccaaacttttgtcactgtctttttaagttgattgatttttacgatgttggcggctgagtaatcttccgaaatgctttggttacctcgggttaccaccacgttgttattgtaaaattccaattctacctgatttcccttatttttcttggtgtgaatcagcataattgcatgttgaccggcgttgaaattgtagtttttagtagttggtttcaacaaatatttttgataggatttgggtaatttttgattagccgccaaaatccattttagttttgtagatttataattaatggcaaaaatcatatcttgattccggccagatacaagtaaattgccagtcttttatcatagtacatggaattttgatggaaccagtcagttttaccatctgagcgggtagtaccagagtatttcgtataggcactctgaggcaaaattcgttttaaatctatcactttttttatttttcctgtttggcggtcgatctcgatcatagtatcttcaacgtaatttgcggagccatcatccacagttaataacaagttgtggttgggtaactcaatggcgtcatgatgaataactgtattagttgctaattttttatgatccgagtgggtcggaaacaggccactaaaattatactggcgataaacacgtccataaaaatcagtttcttgtagggcgttatattttggagttgtttcgctaatttttgtgagaattaacaaatgaccattgctcaattgtttaaatacatgtgagatcgattttgtgctgtaccaccggacttttccttgagcatcaagtccataagttatgccttggctacttacagcaaatgttaattttgtatttccagatcccaggaccatttttgagggcttacttgttttgacagcgtttgttccaatatctgtaggtaaggatccagttttcatgacgtaaacacgggaaaacttgtggccacttttagtttcaaaggttagtttaacccgatttgtgcggtcggcatataagcctaagacgccaacgctatgagcattagtataagatttataccgctttttaatggtggttttactgctgtccccttgaacagatacactgacacgagtcgctgctttggttttgactaatattaagccagttaaagggctggtcttgtacggatttacgatgacttttgctttaccgataccagtgtttaagtttgcaagccgttttcgataggtttggcttaagtgattggttgttttagtgtttttggtcgatagtgtgggttgcagattcagtttgatttgcgcggtacttaaaatatgcttactgtgatgaatttgatccactaaaaagaatgtacggatgttcgctcgctcataataggccaatccgccggccagaaaaactagaagtagacagccaatcgcaattttttgccacttacgcctcataacaagatcctctaatcgttttgttttgataatttaagaatagctttaatttaacgtattttaggcagaaaaatcgaatgtttaggaaattttattaaataatctggaggaaagttcagcaaacatcgctatcagatgtgcttatctcattatgagaaactttgttttggtaattttagtgttaaactagatatagatactaaaacgaagggaagtcggctatatgagtcctggacctggagcgcgatcattaaatgaggttaatcgaaattaaattttaagtaacgtacaaggagaaaatacatgattgaagcaataaatcttaaagcaggaatgacatttgaacaaaacggtaagttaattaaagtattggcttcggagcatcataagccaggaaaaggtaacactgtgatgcgaatgaagttatatgacctccgttcaggttctactgttgaaaaaacaatgcgtcctgaagaaaaggttgaacaagcaatcgttgatacaaaggatgctcaatatctttatactcaaggcgatgtagctgtattcatggatatggagacatacgaacagtacgaaattccaacagctacgatccaaaatgaaatgaaatttatgttggaaaacatgaacgttaagattgattacttcaattctgaagtaattggtattactttaccaaacacagttcaattaaaggttgcagaaacagaaccttcaattaaaggcgcgactgttgctggttctggtaaatcagctaccatggaaactgggttagttgttactgtgccagatttcattaaagaaggggaagttcttgatatcaacacacaaaagggaacttaccaaagtcgtgcttcaaagtataacgatgaaaactaaaaagtgttaaaaggatgatttcgatgagaaatcatcctttttttatcgtataataaatatgtatgcgatttcaaaataaaagatagaagtgatttgagttgagtaacattggattgattgatattggcggaacaacaattaagtttgcagtatgggatggtcaggacttggcaggacatacttctcgaaagacaccagccactttggccgaattttacgatgttttgacagaagaagttttgaaaatgaaaaaccagtttcatattgaaggggtcggaattagttcccccggtgcagtgaataagaagactggtgttattgaaggcgcaagcgcgctaccatacattcataactttaaaattcaaccggagttagaaaaacgatttggactgaacattagtatggaaaacgatgcaaattgtgcggctttagctgaattagcggatggtgctggacagggggcagacagcttactgtttttggtgattggaacaggtgttggcggttcagtcattattaatcacaaaatttggcatggcgcgcatttatttggtggtgaatttgggtttactttatcggatgatacttatactttgagtgagttgggcacttcggttcgagtagctaaaagatataataaaaaaacaggtttggagaaatcaggtaaagaagttttcgatctggctaaggctggggatgaaacggcgaaggctgaagtaaataagatgtactgggcactcgcaaaaggtatttataatttacaatatagttttgatcccgaaaaaattgtcattggtggcgcagtttccaataatccagatctgattccaaacatcgaaaagaacatcgaaaaaattagaaaacaagtaaagattgcttcgcttaaaccagacgtggtctcatgtaaatatacggaccaggctaatttaaggggagctgttgttgattttgaacaaacttatgggtaatagaaaaggatggcaaatttgccatccttttagtttagatttttaattgtttagcagattttgccgccaagttcggacatttctgctttcatagcatttttatcttcggtgggtgttgtgtaagcgtcaacggtaacggcaccatctagtacaccactgtcatcagttaattttaatgaagcattcttatagtcgagcgctaaaccattaccaagaaatgtggtttcgggttctgcggttgtcattgttaaaccagcattgttttctaattcaacaccatattctggatctgattggtcagctacgaccaactggaatttattaccgatcgaacatgaaccaccaagttttgaaaacttactggaaccatcgtctagtgctaaaaatacatgttttcctgcaggaatcttgcttgttaagtaggcttttgcttgatctttaatgttaatcttcattaaattcaccatctttcaaagatttgtttacttgagtacaataagtatcatacatgcttactataaataagtaaagttaactgctcacaacctatttggaattattttgcttatttaatgtttatttaaagtaaggagattaatatgaatttattcattaagaaagcaacagttcaatagcccttttagtggaagagcagaatggcctttcaagatgagatttttcatatgttcaactcccctgtaataattaacttacatcattgaaagctaactcccctgtatagctttaaagaccgaatcataccgcgaatgtgattcggtctttttctgtctaaaaagacagacaattaaaatccaaaagcagtttaagcgcgccatttttcttgcggtcagctgaggtcacaagaatggacaacgtccgaagcacgaaagattttcggcccggaattcaactcaaaaagtcgtgtggttctttttactacagcaatgagcaagaggtatcaaaataaaagaatattttttggcttttaatcttcgtttaaagtgaaggttttaagatgtgtttattcattaagaaggaaccactccaacaggtcattttaatgacgtagcatgatttggtgttcttaatgaagatgagtttttttgagagaaaaatagtcattagtatttgagaaagaagtggttttttcataaccttccaaattggaagaagatggaatattttccatatgttcaactcccctgtaaaaattaacttacatcattgaaagctaactcccctgtatagcttagagaccgaatcataccgcgaatgtgattcggtctttttctgtctaaaaagacagataattaaaatccaaaagcagtttaagcgcaccacttttcttgcggctagaacttcggccacaagaatggacaacgtccggagcatagaagatttccggcccgaaaatcagcctaagtcatcagtatgaatttagaggatataaaaaacaaccattcctaaaaattcttaatcttcgtttaacgtaacttacgtaaaatgagtttatcaattcaaggagatgaaagaatgaattatttaaaacgttcaacgctttatttgacccataaaaaagggcaaagcttattattgctgttgattatgtctgcaattctggtttttgtattatcaggaatcattattcaaaacgccgcagtttctgcgacaaatagtgtgacaaaatcggcaggaactacgattagtgtttcggccaatcgtaacaaaatgttttcgaagatgcgttcaagtgtgtcaaagtcaaagacaaagacgatcacaacaccgacagtctctaacgcaaaacttaagaaagcaggtagtttaagtactgttgcttactataatattaccaatacagcttcagtaaacgctagttcgtttgataccgtttcaaccactactggttctcaagggggtggcatgatgaaaggcggtgccagcggtgcatctactggtaatatcaccattgatggcgtttcaagcacaaagcttacttcttcattcatctctaaagaagataaaattgtttccggacggaacataacgacaagtgatgccaatagcaagaacgtggtcattgaaaaggaactggcaagttctaatgggatcaaagttggagatacaattaccgtaaaaatgacaacttctggtaaaaagagcattaaattgaaagttgtcgggatttacaaagctaaatcgacaagcacaagcagtatgcctggtagtgatcctagcaacacaatttataccagctacacattacctgccacaattactggtacagagggtaaatcaagtacagttacctatacactttcaaactcagcaaaagaaaaatcaacaactaaaaaaattaagagcattataaatagtagttcgtttagcgtaagttcaaacgatgaaagttatcaacaattgttgcaaccaatgaaaaacgttcaagcatttgcgaagaagattgtgtggttagttgcaattgccggaacaattattctcggtttgatcattatcctgtccgtaagaacacgtcaaagagaaattggtgttttagtttcactgggcgaatcaaaaatgcacattatcggccagcttttctcggaactgtttgttattttaatcggggccatggttattgccctgctattaggaaattttgtgggcaacaaagtgggtaatcagctgttggcccaacagcaaacaacgtccgtaacctctacatcaggagccaatggtggtcctggaggcggcggtgctcctggatccagccaaactggcggtggtatgcgtggtggagctatgactactcaatcgacaactagttctgcaagtaagaaagcactgaagactttaaacacaagtatcagtccaagctcagttattaaattaggcggaatgggcttagttattattgccttagcagtttgtgtttcggcaattagtattttgagattaaggccgaaggatatcctgataggtgaataaaagctatagcaattcaaaaaataaaaaaatccaagaaaaataaggagttgaagaaatgttaacagtaaaaaatttaacccactggtacggacaggcagataaaccactatatgaagatgttgatttaagttttgattctgacaaagtctatacaatagttggtgcatcaggatcaggaaaaacaactttcttatcctttattgccggtctagataagccacaaaaaggagatatttttttagatggtataaacattaaaaagattggtgctaccaactatcgaaaacataaagttgcaattgtgtttcaacagtataatttattaaattatatgtcggcattggataacattttaacggccctatctgtcactgattcagaacataaaggcgaaaaacagtttgtccttgattctcttaagggcgtcggaatcgaggaagctgatgctaagaaaaacgtgcagaaactttctggcgggcaacaacaacgagttgccattatccgggcgatgctggtggatgccaatatcgtaattgctgacgagccaactggaaaccttgatggtgaaaactcggctatgatcattaagttgttccaggacttagcacatgaacaccataaaactgttattattgttacccatgatccaaaaattgcggatcagggcgatgttaagatcagtttggaaaatcgagaatttgttgttgcataacaccaaatacttggaaaatggggttaagacaatattattctttgtcttaaccccattttgtaggttaaaatggtaaagaaatcaaaaaaagaaattagggatgcaagatggcagatattgtaaaaattttattaattgaagatgaccatcagctttcggacagtgtacgtgactttttagttgatattggttcagtcaagcaagcgtttgatggtgaagaaggcgaatacttggcaactgaagagccttacgatctgttcatcgttgacctgatgttgccgctgatgaatggtttagagatcatcaaaaatattcgaaaagaaaaaattgagacccctgttttagttttgacggctaaagatagtttggaagataaaattaccggctttgatactggggctgacgattatttaactaagccgtttcatcgagaggaattaattgtgcgggtaaaagccttgctcaaacgcagtggtgtttatcaagatgacaaacgattgatggtcgatgatgacatgtggttaaatactgagaatcgacaagttacagttgatgggcaaccactaaaattggtgggaaaagaatacgagattttagcgtatttagcacagaataaaaacattattgtgtcgcgagaacaaatttttgaccgaatctgggggatggattccgatacgacgattaatgtcgtgaatatttatattagtaatcttcgccgcaaactagaaaaggcaggtcggccaaaattgattcaaactttacgtaatgtagggtttcttttggaagtgaattaatggataaaattgtaaatcgaaagcaacaaattaagctatttttatttgagttctttagttttttaattgtttttacaatcttgggaacgattatttttgttttttatcaacgaaatacctataccagtattgataatacgctgagccggcgggccacaatggctgccaatagtaccaatatgatggggccaccagattttcaaacgattacggtgtactataattcgaaagggaaaattgttaattcacaaaatttgagtaatatgtcgagttcagtttccaaagttaaagttggtaagtcacagctgaacaaaatttataatattaaggttggtagtgtcacaatgcggggagtttatttaaaagtaaattctcaattgatggtaaaccgaagtgggaaaaccttaccgacgagccagcagcccaaatatgcattggttttgaaaaatattacaccagaaattcaaagtattgatcgattcaagaatctcttgttagcctctttcatcgtgttcggattaatcgtctttatcattagttacattatttccaggattaatatgaaaccggtactgaaagcttggcaacaacaagaggaatttgtggatagtgcggcgcatgaaatccgaacaccattgacgattatccaaaataaacttgaaggcttgatgactaaacccaatgacaccataaaaaatcaggtgggggctattatcatgtcgctttcggaaatacgccgattaaatggattaacgagtgatatgttaacattggcgagggccaattccaacgtgattacgctggaaaaagcgccagtggacttttcaagtttcataaatgaaattctggaaccttatacggatttgattgctagtgaagataaaaatttggtgaaatcaattcatgtagatcgcccagttttgttagatgccaaacgggtgcaccaattaatcgttattttattggataatgcgataaaatatacaccaaaaggcgcgacgataaccgttaatagtaatattgaagctcgtaatttaaaaattcagatttgtgatacaggaattggaattagtgataaaaacaaaaaatcagtttttaaacgattctatcgtgaagagaaatcgggtaataagcagaccggtggaaatggattaggtttgtcaattgcggaatggattgtccgcgcgcataaaggaaaaattaaggttactgataatccgggtggcggtacgatatttaccgtgcttcttccggttactaaataaaaagaggtcgggcaaaactattttttacctgtcctctttttattatgcaatctataacttcaatcttaatctaaactttgttcacacattcttcaaactttttatttaaagtaaatcttatcttaagtataagaaaaatgtaggaggatcgtcatgagggatgaagaatgtagttatcaaagatttgaggttgtttgtaatcagtgtcccatgattaagaatgggtttgggggacgtgccattaaggaatatgaaaatacctatttgattgaattggacatggagaccgtctgtcaagaagaccgacatagcttgatgcggattacggattttaatgggcgtgtagttattgcaaagaagtatattaaagcggttgaagatgagatggttcaataaattacgaacaaacttagccgacgcttactttattttgtaagcgctttttgttatgattaaatcaattatgaaaacgcataggagattagacatgacaaatagattaattgctgttgatatggacggcacattcttaaacagtcaacaaaattttgatcggcaattttttttagagttgtatccgcggatgcaagctaagaacgtgacgtttgtagtggccagcgggaatcaggattcacagttacgcgcgttttttccccataccgcagattcgatttggtttgtgtcggataatggggcattagtgaagcaacctgatgaaacaattgtgtattcggcaaagatggatcccgctgtttatcagcatgctatttcatttttagctagtctggatgacgtctatccggtggtgagtgcacaaaaaagtgcgtatgttttggattcagctcctaaatcatttgccgagatgacggctaaatattactataaactaaagttagttcctgatttggctaccattgacgatccagttatgaaaattggcatgtcgtgtccagatgagaaaacggaagaaattttgcagttgttggatgatgagcttgcaggtaaattattacccgtgtcttcaggccatggcgatattgatttaatcattcctaatacccataaagcaaatgcgattaaacgcgtcgcagactttctggatatgccgatggcaaacgtagttacttttggggatggtggtaatgatgtggagatgctaaaggaagcgggacaaggatttgcaatggcaaacgcgccgcaagctataaaagatattgcagacgaaattgcgccaagccatgatgaaaatggggtcttggtgacaattgatcgattgctaaaatcgtggtaacaaaaaagctggagaatagaaaacgaggtcggacaaaaacatagttttgtccggcctcgttatattttctgaatgttatttctaaactttgaagaaaaaggcagattcttctgattagtctaggcggcgctcagaacctaactgcccttttggtttaataatgtcttgatctgcgataccgaattctaaataaggttccaaacacaaacgtgactagcataacgagataggtaatcattttgtaggttggaagctggtcgcgaaattcgagcaaatattgattttgaaacgcactttgatattcaccagttaattttgtctcaatcgatgctccaattgaagaattaataatcagtgtggacacgccgtccgcttgaagttgttgtttgacactattttgaaacgctgttggatcgacttttatttgtttaccgtcataaacttgcccaacggcagttttaagatcaggtttaataacagcttcagtgagttgaacggaatagccatcatattgaggtagcttttcgtttacaacactcacaatccggtccacaatgggatcgcttgtggctacaatctgaccgaaacttttattgaaaactgtaaacaaacagattgttgctagaatgaaaatgaagtacaaaaatgtcgaaaatgcacgtgagccatatttaggtttgattaaatgctgttctctgatagttgtgacctcctgtttgaaacgtctaagtttctcaaagataagccacaaactgccttttgtcaattggtcataagttgatagggctcttcttctggattaaaagtagttgccaaccaacttagtgacgtatctttcaccaagttttcgtaacctatccgagcaatgtggtcattcatatcttgtaaactttgcccacttccgaactttttgagattcatcggatcattgacggtagtgtgatcgaaaattggtgatgccaacaaaatggccgccggcaatggggttggtgtgtcaaagtaatattgcgtgtctggaaactctaaaatagaaatcgtgttgttagaaacacgaccagggtagtaaacagcaaagcctctcatgatgaaaactgttaatgacttaaggtcagtaatcggataacttttatatagattaccctcaattatgatatcaattttgtctttgtcataagccacggttgttttggaacgcactttcggtcgagaaactcgtttttttaaaagacttttcccaccacgaggatattcttccccatcaatctgaatgtggcaccaggataaaaacggatcaacgccatctttttgtggcttaaacgtaatttgagattttaaaacatcagcactaattttcataaaaatctacttcctctaagaaataaaaatgaatatgaaaccgtttacttgatatcacaccgatatcatagcaccatttgttcaaaataacaatctaaattgcgtttattctagatttttataatttaattggattgtcaaagagctctaaatctttttgacctccaaaccgatcgtaccaaggagttgcatagttttcgagaatatcatttagatcagttaagttcttgtttccagttgtttctaaccattgatggagacctttttccccttcagtagcgtaggcagtgataccatcttggactaaagaatagtcggtcatcacaccagaaaattttgctccagcctttcccgcaaatttaaccgcagtttgaaaggtttcaacagaattatcaccagtttgaaaaataaatggccgcgtggtggtgtcactggcttctttcaacaattttgcggcttcacgttgagaataaacaacggttgcattgctttctgcaaatccttctgtgtaagcaaagttaattggtgtttctatttgaagaatgtcaatgtgatatcgttctttagttaattccttaatggtatcgatgaccagatcaggttgcaatttggcaaactcggcgcttgatttatcagaaacttgatcatcataaacaacgggttccacaaagaggggcagatcagccgctaaagcttctgcgccgacgcgttctagtagcgcaagtttttgatcagttgtctgttcatcagtgtggggattgtaaaccacgcgaactttgacgccattcgttttggcatgaactaaacgatttaaggaaaggtggtcaggtgtttgatcggataactcatagacggtgattaggccagtatccttggatcgagattgcatggctttagtgcccagcgttggatccaaaagcactccggaaacatttggtgataagaactctgataaaatttgcttaaattcgatgcattgatcaacttcaaattgatggccggcagactcttcagcagttttcatcatcgcttgaaatttagtttgttcacctaatcccagaatgttaatggtgccttcgtcatctgctagtttttgtaagttttcaaatttaccgcgtgataatttagttgtcataaaaataatctccttatatttaagttacctgaataaaccgtatcacaccagaccgaaagtttaaattaattagatggttaagaccagtcgccatgaggaaaaacgaatcaattttgtagcacattgatacggacttgaggcgtgtaaaaatgctataatggtaaaaatatttaatgaggtgatttggtgtcacatgaagctgaaattaaagcctattggcaaacgtttgtaaaggagcagcagttaaatggtgctgtttacagtgcttggacgtttggctctacacctgagatggcaaatgaacttgctgatttgacattcagaggtataaaaacagccacaacttcggcatatgatttatatgaagaagatgaggcttatccgcaggtcggtgaatataacatgattttggatggtcatggtcatccagtttgcatcacaaaaacactcgctgtggaggtcgttccttataaaaatgtaaccgctgaacacgcgtactacgaaggcgaaggtgatcgcacattagcttattggcgtaaggtccatgaggcattttttaagcaagaatacaaagaggctggcaaaacatttagtgaagatatgaactgtctttgtgaactttttgaagtggtaggttaactttgttttgtgcgcgcttcaagagctaacaggtcacgttttaaaggcaaaccaccatgataaccaccaattgaaccgtcttttcgcaatacacgatgacaaggaatcacaatttgattggggtttcttccgactgcattagcaaccgctcgaatggcagttggtcggtggattttttcggctaatgcactgtaagttgtcgtttctccataaggaacattgcaaagagcttgccagacagatttttgaaaagaggttccgttgaactctactggtagagagaatttttgcgattcgccggttaacagttttttaagtgctagtgcgtagacattggtcttaaccgaatttttcactttttgaacgtgaggaaaataatgctgcaggtcatcttcgccatcagtgttcgaactgacaaaagctaaaccgcggtcacctactgccaaaagataagtgtaagagccaacggtgatgtgatcgatatacaaggttttcataggggtgcctcctgaacaatagtttgtctaaattataacaaataaaacgtttataaattgattttttgttaaaaaggctgttggcggaaataaaagtgggtaagggatgaacttgagtgaatgataaactaaattttgaaacaggtgttaaagatgcgttgccaactgtatttgggtacattggcattggtttggcgtttggaattgtcggaaaaacgagtggtttgagtgttctagaaattttcttgatgtctttaattacatatgctggttcggcacagttcatcatggtaagtttattgctggttggcagttcaattccgtttatcatgttgtctgtattcttagtaaatgcgcgttttatcttaatgagtaccacggtagctcaatattttcgccaagattcgatttggcaaaacattgggattggtactttgctaacagatgaatctttcgcgttaagcatgaacaaacttaattttacgaatcatcgtttggcaccaagctggtttcacggggccaatctggttgcctatctcacatgggcgttggccacggcagctggtggcattcttggaaatttggttggtgatccaaaagcgtttggtcttgattttgcccttgtggcgatgtttatcgggcttctctacctgcaaatgattaccgatcgcagcaaagcatttgaatttcaggttgttatggtggtcattgtttgtgcgttaatgtatggcttgacaatcttcttttctgataatgtggcgttgattgccacgacattgattggatgctttttaggaatggtggtggaacaatggcgatcacgatgaaagttatgtgggcaattattggctgtggcttggttacatggctgtcgcgggtaattccgtttgtactggttaaaaacttctatttaccaaagtggttgattcgctatttgagttttgtgcccattgtcattatgacggcgctgattatggaaaacatttttactcatcacgctggctcgttaccaacggtcaatctcgataatttgttagcaactgtgcccacgtttatcgccgccattatttctaaaagtttgattgtgattgtggtggtcggaattatttgtatggcgctgattcgcctagttttgtaaaaagatgcttgacttgcgaaatcaactctcttaatatgtaattaacattaaaagcattgagacaaccgaagtagcagattatccaacatttcagagatctggtgggattgcgaaccagaatgtgataattgtgaattacacttgttgagcttctaatcctaaattagcgattcatcccgttatcgatgttgagtgattacattgaactgtaataacttgggtggtaacgcggaaaaattcgtccctagagtctttattgactttagggatttttttataccaaaaataataaggaggacgattacatgaatattattgatgaactaaaatggcggggtgccgtcaatcaaacaacggatgaagaaggattacatgaacttacagataagaaacaaattggtttatactgcggtgttgatccaactggtgatagtttgcatattggccatttgattccctttatgatgttgaaacgattccagcttcagggtcaccatccggtaattgtaattggtggtgggactggtgccattggtgatccttcgggtaaaaactctgaacgagttctacagactatggaacaggttaaacataatgaagatgcgttatccgcacaaatgatcaagctgtttgggacgaaaaactttactatcgtgaacaactacgattggctttcaaaaatctctttgttagatttcttgcgcgattacggtaagttatttaatgtgaatacaatgttgaataaggaagttgtcgcaagtcgtttggaagtagggatttcatacacagagtttacgtaccagattttacaatcaattgatttccttcatctatataaacatgaaaatgttcagttacaaattggtggtgctgatcaatggggtaatattactgctggaattgatttgatccataaaattgaaggttcagatacagatgtgtttgcgctgacgattccattaatgttgaaagcagatgggactaagtttggtaagacggccggtggagctgtttggctggatcctaagaagacgtcaccatatgaattctatcaattctggattaaccaggatgatcgggatgtagtgaaatatttgaagtacttcacatttcttgatgaagacgaaattaaggcgttggcagaaaaggtacgtacggagcctgagaagcgtgaggctcagcgtcgtttggcagaagaagtgacggaatttgtgcatggcaaacaggcagtggttgaggcacagcatattactcaggctttgttctctggtgaggtgcaggatttaactgcagaagagattgaacagggatttaagaatatgccatctgttgaggttagtgctgagaagaaaaacattatattgtggttggttgatgatacgaagattgaggcttcgagaagacaggcgcgagaagatgtaaagaatggtgcgatctggattaatggtgaaaaggtgcaggatgtggatgcagagattgatccaagtgctcactttgaagggaagtttgtcattgtccgtcgtggaaagaagaagtatttcttggtgcgaattaagtagagtgcgcgaggcaaaatggtaagaggctgattataaccacgacggatgcgggatcgcaatcccgcgggagtcgtggttataatcagcctcttattttgccgagcggtcctaaagctcagcggagaaaagtagggaagctgggtgacggatgcgggatcgcaatcccgcgggagtcgtggttataatcagcctcttattttgccgagcggtcctactgattaaacacctagaaataatttgaaatctttgctcttctatatacagaagcttttctaaagatatgggaaaattcaaaaaagcgtcaaattatcttaggcaatgtgctgtttgataatttggcgctttatgggtatttgggatcgtacgtgtttattattttaatgttagattttattaaaggtaataacttcttgctagtattaaacgcacagatttttcaccaataagaataggtaaaagcatttcagaaatggatatgtcaatttagccttaaaatgaacagagaaactaagacgattctgttatctgcctagtaaagtctgtttaaacgctctaaatgctactatactcatttgaaaagcagcagatttacaggatttctattcttgagttgaaatgcttttctaaaaattgggtattttcaaaaatttctttttcggatattacttctttttcagatgtaactacccattttgtctcaacatcatcatcacgatgaatgattgcgacaagtataccagtaaaagttccgatgggagtttctgcattttttgatatcacatagacatcctgcttttcaccatcgccgccaataataccagaaatatagccgtagtttaatggatatacgtttccaaactgatccacatatccttttggtctgtcgattgtaacctgcagttttaatttattcatactaaagatcctcctcatatgtcactctttgggccgcccaatcaatctatatccactaattgtttagcagtggattgaactttggtttgtgaaagtctcacatgtttatttttgaacaatatggatcttttgaaaataacaaatttcaccatctatataaatatatcgttgcacaccggccacaagagttaacttacaaccagagattagctttatgtttattttgaacgatgccccaagtaatcatcttgatagtgttgggtcaggtaatcatggatttcggtcatcataagttttgtagagggggatgcagcttgagttttgttgacactgagacagattgtgcggttgtattggtgtgaaaagggataaacattcacatcaccagtcaacttttgcagcgctagcttaggcaaaattccaaaacccagtccactttctaccatagaaaggatggattgatcatcgattgaataactaatggctttcggggccacgttgtattgatccaaagttttcttggtatcacgatcatagtcaatttgttgaagaataaaatgataatcaccaatgtcatcggttgtaatataagttttgtttttgggtacaaagtttgctggagtgacgcagtagataggatcctcgattagagattctgtttgaagctgcgaatctactggaagtgtggcaaagccaatgtcgacagagccaatgcgagtcatttcggtaatttctgaaaaggtcccttgggtgattgtcacctcgacgccaggatattttttcttaaaccggcgaataattgtgggtaaccagtttatgcacacactactaaatgcgccaattcgaacggttcctaaatttagaccacggatttgatcggcaacttgttgcaactgagcctcactgtttaaaatgtgctgaatgacaggtaaaatttgttggccatctggtgtcagttccacaccagttcggttacggataaataatggaaatcctagttcatgttctaattgactgattgcatgactgactgcacttggggttacgtttagtatttttgcggcttgaccgaaattgttagtggtcacgacttgagcaaaaatctcatatgaaaaattagccatctaatgcacttccttctatatataagtatgaaacgtaaatttcaaatagtttagtgatgaaaagcattcacgctctattgagaacgttgagttttacttcatactaaataattagtatcatagagtcaataaggaaaccgaaaaagtatggaggaattgtaatggaagaagaatttgctagtcgagtttcgttaacttcaaaaagtgggttgaatgctatctatccaagtagagatcctgaaatgatttcttttacgggtggctttcctgatgccagcttgtttcccaaccaagaattagcagaaagttttcaaattgcagttactaaccaaaagtcacccttacagtatcaggtgggtgaggaatctgtcgagctgcgaaacaaaattgctgatttgttgaatgctgatggcacagtaacttgtgctaatcagattatgatgacacaaggtgcccagcaaggattggacttagttgctaagcttgtaattaacaaaggcgacggtttggttgtagaaggcccaacttatattggcgcattagctgcgtttgatgcttatgaaccaaattacttttccgttagcatggaagatgatgggatgaatttaactgaactaaaacgtatgctaattcaaaattccataaagcttatctatacgattccagattttcaaaatcctactggcattgtaatgtcattggaaaaacgtcagcagttaattgaattagctaaccgttatgatgttttgattttggaagatgctccctatcgctggctaagatacgaaggggagccattacctacattgaagtcaatggacacacaaaatcgtgtaattcaattaggaagtttttcaaaaatcttggctcccggattgcgtttgggatggttatcagctggtggtcaagtttttaatcggctgcaagaattgaaagctggtgcggatctagagacttcaaatatcatgattcaaacagtgaatgcttatctatcaaagtatagtttgtcgaaccatctagagaagttgcgaaaaagttatcgaatcaaacgggatgctatgatgaaagcaatgcaacaatacatgccaaacaatgtaagttatacgaaaccacagggtggattcttcacttggattactgttccggagaatatcgacctagaaagcattcaaacaaaacagttaaagcccagttttcatgtgatggtgattccttcaaccaatctgtttccagataaatcacataaaaatggcgcgagagttagttttagtagcgtttctctttcacaaattgatttaggcgttcaacgactaggaaatggcttatccgatgggtatcaaaagcagtcaatctgaaattggtataggtgaaaaacacggtgattttcagcaaaaaatgaaacaaatcaaaacaaatttcaaaaaatgcttgacgaaatgtttatgacttggtatatttatatacgttgcctgacggagaacagcttgcttcttcaaaaaagaattaaaagtttttgttgacaagctgctagccagatgatatactaataaagttgtcgcaaaggaaaaagaaatttttcttaaaagacaattgactgacaagtaattcgatgctgatcgttttaaatcggagtgcggaaactgcccgaagaacgatcggcacagccgagataattgaagcggcgataaatgaaaccgtgtagaccatatcgctgtcaacaactttccccaagaggcctacgccaattaatactgccgttatcagtgtaatttgatttgtatgttgattaatatatctttggaatttcataatctcccgctccatttctcaattgatgtctttagtatatggtggttcggccgataaagaattgacgtggatcaagtttgaaattttgtttggtaattgatggcgaatattttttggtttttcggtgattcgcgatggtgacgtttcagagagcatgtcgatcgttaaactttcagcgatcgaccttcccctggtcatcgtgattctggttgtcgcactaatcgttgctttaaaaatcacccactgcctgcttagtacgttagatttgcaaaagaaagattaggccaatgtcaatctttcttttgcattccggtcttatatctaccataattgagctaataaggataagggaggattccaacaatgaaaattatcgtgattggtgcaactggccgggttggttcaaacgttgtcgccaaactcgccaaaaattctgcagacgaaatctatgccggtgcccgcaagccggaaaaagtgccaacgtctgagaacgtgacgccgtttaaattggatctcaatgacgggatggatgagattaaagaggccttaccagaagccgatgcaattatcttcactgccggatcgggtggtcgagacctgcttaaaattgacttacatggtgccgtcaaagtcatgcaggcagccgaagaaaaagaaatcagccgttttgtcatgctgagttccaagggatcattgtcaccagacgaattcgccgactctccgcttgagaattacttgatcgccaaatactatgctgacgaatggttgattcacaacaccaatctggactatacaatcctccagccaaccgcgttggttgaaaaaaccgggtcaggcaaagtgactttgggagcctatagcaccaatgaaaatagcatcgataatgtcgccgacgtattaattggtttagtcgaaaaccatgccggcatcaaagaagtcattgagatgagtaccgggaatgaaccgattcctgaagccattaatgagttaaattaacaaagaatatcgtgatacagagtatgtaataagggccggaacacattgaagcagcacttgtgttccggcccttaatgttagttttaattacatataccaattagcgggcttcacctttttaataaaatttgatatcttaaagacgccttacccagcgccattggcaccgtttccatcgcgattagatacattctaattttctaaccaatttcaaaaagtgctggacgttccaaaaatatgatgttagaatttatgacattaaaagagaaggaagcgatgttatgaatgctgcaaatacttcgttcatgattttatccagtattttggtcttattcatgactcccggattggcgtttttctatgggggcctggtttcaaaacgaaacgtggttaacacgatgctgtcggttttcattatgaccggtgttgccattgttctttggatcgtgattggttactcgttatcattttccggagacattggcggagtcattggaaccgtgaagaactttttcatgaatggcgttgatctgacttcattgacggcaaccaagattccgactgggattttttcagtatttgaaatgatgtttgctattattacccctgccttattcgtaggtgccgttgttggccggatcaaattcaactttttgttggttttcttgattctttggtcgattatcatttactacccaatggtccatttggtttggagcccacacggtatcctttatggattaggcgtattggactttgccggcggaaccgttgtccatattaatgccggtgtcactgcctttgtcctttccgctttcttagggaaacgggttaaattcggcgacatccctcacacccactacaatttaccatgggtattgcttggtgccaccatcttgtggattggctggtacggatttaatgccggttcagcactcggtgttgacaacattgcggctcaggcaaccattacgacgaccatgtcaaccggtactgcaatggttacctggatgatcttggatatggttatcagcggtaagccaaccctggttggtgtttgtaccggaacgctttgtggactagttggtatcacccctgcctgtggctttgtaacaatcgccggatcattttggattggcatgttctcaactttcgccagctacttcttcgttaactatttgaaagatcgaattggtgttgacgatgctttggatgcctttggctgccatggtgtcagcgggatcgtcggcagtattgccaccggtttattcgctaccaagagcgtcaacccgattgttgcccacaatggcgccttttatggcggcggttggcatcaaattaccgtccagatcgtcgcaactttggcaacgattatctttgttaccatcgcggcttcagtgattatcaaattactgagtttagtgatgccaatgcgagttgaccgtaaagaagaaaagcttggtttggataaaggtgagcacggtgaagaagttgattataccgttgacatgagcgacaaccttgacgcctaccgttcagatttgaacctgtattccaaggaattcagaggccagttaggtggactggatcctaataaggaccctcatttgcattgagttagacattcataacataaaaagcaaaaagaccggaacaggcgttgaaaagcgccttgttccggtctttttgcagtcaagttactttaaattcaattacttcttcaaaatagccagcatagcaccattaaaatcgtctaaatcatcaggagtgcggctggtaaccaaattacggtcaaccaccaccggctgatctttcacacgggcgccggcataatacaaatccggtcgaacagtcaggtaggcggtcattgtccgaccagccgtcaagccggtttggatgaacagttgcggaccgtggcaaatcgcaaaagttggtttgtcgtccatcaaaaaggctttgacgaaattaacaaatcgatcatcagctctcagttgatctggtgaaaagccgccagggatcaataagccgtcaaactcatccggcttcacgtccccgattcccttatcggcagtcaacttagtgccgtgtttgccgacgatttgattgccagcttcattttcaatggttaccacctcatggccggcattcttgagtgcttcaaccggtgatgtgtattcaatatcttcaacatcgttggtcacgatgacagctactttactcatcaaattcatcctttcttgttccaagatactatctactttatactaggtatcaaaatgatacaataacgcactttcaggtgcctaaaatcttggagggatacaaatgactgatgtcatcagaaaagatgtcaaagaccgtctgaaaaacggtgactacaactgttccaaggagctcactttatcgatgttcagcggcaaatggaaattggtcatcttatttcacttgggaactgacggcgcctaccgctttaacgaattaatgcggctgttacccaaagtcacccacaaagtgctcaccaatcagctgcgggaaatggctgaagacggcctcattacccggcatgtcaactcgggatctcaaacaaaggtaacctatgaaatcaccgagctcggtcaatcactgatgcccattgccaatcagatgtatgaatggggcgagaatcggatcaaagcccttaaagtgactccacaattcagtgtcaacgaagaagttgagcgggaggcagccaaatgacctattccagaaccgaatcaattgaattggtaaatatgtgcatgatttacaatccagccactcaagaagtcttggtggaagataaaaccgacgtcgcctggaaatttggccacacttttcccggcggccacgttgaaaaaggtgagagtctttacgacggcatggttcgagaagtatttgaggaaaccggcctgacggtcagtcagctcgaatcctgtggaactgttgaatggttcaacgaaagccctgcctaccgccggctcggatttctcttccgcaccagtcatttctcaggcaccctcaagcagtctgaggaaggcaaaaattattggctgccgttaaaggacctcaacgaagctaatacagctgaaagttttatgaaattcctgcagatcttcaccgacccccacatcgttgatgcaacgtcgccggtcatgaacggatcgttaaccataatccccaaagacgaccattccccaaaagcgtaatataataaagttgtcatccgaatcattcctttgaggaggtgcaacatgaaaaaatatttaattatttataatggcagtgccggtaaaagcgacaacgaagcgattgccaaaaaggctcaatccttattggaaagcaatggcaagtcggtgacccttagtcaaaccaagtcacgtgatgatgcggtcaaacaggcccaaaaatcacccgaaaactatgactgcctgattacgattggcggtgatggatcgatcaataccgcctgtgagggcttcttgaaggctggccaatcaattccgctgggaatcattcctggcggcacgatcaataattttgccagagcccttcacatccctctgaacaccgatcaagccattaacaatctgttggatggctcaccagcagaggtcgacctcggggctgtggggaaaacaccaatggtcagcagcctcaccctgggaagattggcagatatcgctcgaaacgtcaaggacgacgaaaagaagcgctttggcaaaatgatttatttggtcaaaggcttcaaggagctgttcaccaatcgttcttacaaattaaaaatcacagccaatgatcgctccgaagtcttgcgagcccagattctactgatcacgacgaccaattcggttggtggtttcatcgcctttaatccggatgcgtcctacgacgatgattatctccatgtcttcttgctgaagagcttcactcccatgaaactactcacctacttgagttatttcatcaccggcaatctcaaaaatgcccagggggttcgctattttaaaaccacaaccgttaaaatagataacctgtcaaaacgcgacattcaggccagaatcgatggggatccagcgatgtctctgccaattaccgtcacaaccaagagtgactttttacaggtaattgtgccaagagcatcgcacgaagaatcttgatcctaggatttaaacaaaataacaatggcacgcaaaagaagccgggaggtaacgaacaaaacgttatctcccgacttctttacttttcagtcaatttattttacgttcattattcttgaggatcaagtgcaaccaagccaccggcaaggttacccatgttaggcttgtcagtcttgacgatcaactgctcgttaacaaaggccatctgaccaatgtggctcatttcacggccgtaacctgaaagtttaaccccaccaaatggcaattcaggtaaggtggacatgaagttgttaacaaagaccattccagtttcgatttgtgaggcaacttctgcaccgtgatcagcatcgccggcaaagacaatgccaccaagtccgtaagggttgtcgttggccaagtcgattgcttcctgctcactgtgaaccttgtaaacagcagcgattggaccaaacatttcttcactgtatgctgggttatctttgtcaatatccgttaagatcgttggcataaagaattgaccaggtaagtcaattggttcattaccataaacaactttggcaccagctgcgatagcatcgtccaattgtttctgtaacttgttctttgatttttcggtgttcattggtgctaaggtcgtcttaggatccattggatcgccaggcttcaaaccagcaaacttcttcttcaaattctccacaaattcatcgtaaacattgtccatcacgatgaatcgcttggatgaagtacatacttgaccagtgttgtaaattcgggcacgccatgcaatgtcattgacatcatccatgttggcatcacctaaaacaacaaatggatccattccaccaagctccatggtgttcttcttaagcgctttaccagcggcgccggcaacagctgtaccaccacgctcagaaccagttaaggcaaccccttgaacacgagggtcatcaattgcttcagtcacttggtcgtatgaaaggaacaagttagtcaacgaacctttaggcgcaccggcttcggcgacaacgtcagcaaacattttagctgatgttggcgtgttggcagcgtgctttaagatcattggatttccaaccataaagttaggtgcaaacacacgcatgatttggtagtaagggaagttccaaggctcaaccatcataacaactccggttgcgtgatgttgaatttcagcatcaccggttgcaatggtatcgatcttttcaggcttcagtaagtcctcaccatgatctgcgaaccagtcagcaatgatcgcaaccagttcaacttcaccctttgattcaccgattaatttacccatgtcaatcgtacatgcacgagctaattcatctgagtgctcacgcagcttggaagcaacgttatgcagaattttggctcgctcagaaatatcttgcttcttcatcgtttcgtataaatcatgacccgttgccaaggctgattgtaattcgtcctcagtcgcaaatgggtactccttcacaacttcattgttgtaagggtttacagtccgatatgccattatatgacctcctaaaatttggataaatccgtaacgtcttcagctatcctagacatttttacatccagatataggatagcatgccgtgaaaacagatacaacaaaatgcattgtgattttcaaagtggttgacgaacgcaatggttaacgtatattacttgtgaaaatagttttcatttcacaaagccaaattaagctttgcccgcctgctgttgcgtatccttaattttgaggaccaagaaaatggcaatgatttccagaatgagaaaggtgaggaacacgccgttgaaattccggtctcctaatacaactgtcgcaatgacaatcgcggtcgaccccaaaatttgcctaatcgtcgcaataatcgaagagccgtggggaatcaaatcgttggttaaagaattggctcccagcgtggtggccggcatcatggcaaaggcattcccagattcaattacaattgaacatagaatggcaatccaaatatttttcaaccctgatagcaacaataaacctgcccagccaacgatgaataatccaaaaccaatcataatgactggcttaaacccaatgcgatccgctagccggccactccgtcgatttaaccaagacaagatagctgcggcaggaaccagtgccaggcctgaccataacggcgtcaatcccagtatctgctggtagtatagcggcatgataatggtgaccgtgatcaaggacatataggacaatgaagttaataaaactcccaaatcaaagttagtgatcgacaaaatatccagtcgcaataatggctgtggcatgcgcaattgtcggcgaacaaataagaccagcagaaccaaggaaaccaataaaatcccccagttccagtagctagtgacagtcatatgagaaatttcgttgataaagtacaataagccaataattcccagcgacatgaagactgaagcaaaatcaaactgagttgattcaattttcaacggactaatgacggtcttgagtgccaacaaaaagaccaccgtcagaataatcaagaagaacgcaaagatggcttcccacgggaaaaattgcaataagacccccgagatgatgggtccaacagccagtgcggatcccatgaccaaccccacagtgcccatcacactgccacgatgatcggttggtgtgatttcaagtatgatcgattgataagatggaaataagaccccaacactgaatccttccattaatcgacccaccatcatcaccaggaaattcggtgcccagataataatcaaggttccaacgacgaagtttaccaataatgaaagatataatggcttaaatcgaaagttcttcatcagccatggtgataatggcataaccactgacataatcagcataaaccccgtcgtcagccaagcaatcgtgctggccggcagatcaaaatacctcataaatgtcggataggcagtcgatagtgacgactgactgattgacatcgtaaatgttcccaacagtaatgtggcaatgaaccacctgcggcttttttctgttaactccaagattattccccctagtgtctaacaaaataggaccggaaatattcttcccgatcctgttttaaaatcatttttaaatccgattaacggacaatcatcactgagattggtgagtacttagccatataggctgcttgcgaaccaaagtacttacgcacaccggtcttagaaagtgaaccgacaatcagcaggtcggccttggtagccggaataacccgtttgacgattgtctcgccgggatcgccttcctcgatgaccgtatccacttgcttaacaccggcacgtaaagctaattgccgatagtcttcaatatgcttggcaagcgctgaacgctccccatgaacaaaatctttgcttaatgcttggaaaacgttaacgttatcgtcttccaaaattgaagtaatgatcaaacgtgcattggattgacgagcttcacgaattgcatatctaaatgctaattgggcatcttccgaatcatcaacacccacaagaattcgatcgaatttttgaccgccttcagtatttgccattttgtaacatcccttcttgatgatgaattatttgggtacaaaagaaatctctttcaattgattattatactattatttctccgcctcggctgctttgctttcagcttcggcagctgctgcttcaaaacgcttgttgctcttgtggatatcccaaatcatccataccaataaagcaacgaccaagacaataacgacgtacgaggcattatcagccattgaaatttggctctgggttggatgatcacctagaaatgcttcgaattggccaggaagacctttcatattcaaagtcgtcagggcgataacagagaaccagccaagaatcttaacaatccacgagtttttgaaacggtcatgcatttctaacgagttattggtaaacatcaataacggcagcatcgagaatggcagggcaaacgccaagaagacctgagaattattcatcagggtgttcaacgcttcgtgctgctgaatcggggtttcacgactcgtcatacccacacaaatcaaaactggaaccaccgaaatcaaacgagtcaccaaccggcgcatccaaagcggcattttcatgtggatgaacccttccatgataacttgtccggttaaggtaccagtgatagtggaattctgacctgacgctagtaaagcgaccgcaaacaaaatcgataaaatccctgacttggcaaccgtaatcagaacaccattacttaaggtcgaaggatccgaaagtgcctggaacagtccgaagaatgacggatctttaactgccccactcttgaagacggcaactcccataatcaatagcagtgagttcaccaagaatgccattgataattgaatgttagaatcccaagttgagaaacgaacggttcgggcaacatcttcttcatcactgtgatccaccttacgagtctgtgaaacagctgagtggagatacagattatggggcataactgtcgctccaatgatcccaagtgcaccagtcagtggcgtttgaccgccaatttgaggagacgaagagaaggtctcgccatttggaaccaagcccttaaagaccccgagccaatcaggatcagacaggatcacttcataggcaaacaccacaaagatcacacaaattaaacaaacaacaatggcctcaattttacggaagccaattttggtcaacaataataatagcagaacatcaaatacggtaataaatactgaaatgaccaacggaatgtggaataacagatacaacgcaatcgcggcaccgatgacttcggcaatatcagtcgccataattgccagttcggttagaatccacaaaacatacccccagcgatttgcttgtccgggctctaatcgcctgggccaagtccatctgagtcacaatgcccagtttagccgccatatactgaagcaacatggcaattaaactcgacattaagatgacggacattaacaggtattcaaaattctgaccaccggtgattgaagtcgaccagttaccaggatccatgtaaccgactgcaactaacgcgccgggaccggaataaccaaatagcgtacgccagaatcccttgcctttgggcacaaccacggttccgttaatttcttccagtgaaggcccattggcgtaatgaatcaaatgttccttttgggactttttttcttttgacatcccattacctccttatcttctgtacaaatctaatggtagcatagtttctagacttgtaaatctttaattagggaaacctaactttctttttataagcagtagacaggagtttttgatatagtaaagaagaaaccggttacttcaattcagaattattttgccggatttgattgaggctggtgacaaattctgcaatcatctccagttcattttttgaataactgtcggctaactcagccagtttggcctcttcttgaccatggtagtcgctatgaatttgattaatagtttccccaggcaccgtgagttctacaaacgtgtccttgcggttatcagggtggtgcgatttttgaagcaggcccctttcagctagcttgttgacggctttggaaacggcgccttgcgtcatgggtacctggtcgacaatcgcggaaatcttcacaccatccttggcagcagcagcgcgaataatatgcagatcgttaatggtaatgccattggccagagcagcgtttaaccgatcgttttgcctgatggccgtcaggatctcacgatcaacatcatgacttctaaatatttctagttggttcttgatttgttcaattgcatttttctttttcattttaaattcctcggaatatatattgacttttcatcatcggagcttatactaattatattccttggaatgtattttggaaagtcaaactgtcaattttaaaaaagaggtttctaatatgaaatatgtcattatatttgaccacccttacaccctgtcggctgcaaataacgagccccaccatcgcagctatagtgcagcggttgccaaacaaacgatcaattatttaactgcccaaggccacgaggttgatgtcatcgacttgaatcaagatcacttcgacccggtgatgcacgcaaaagacctgagtgcctggcgaacacggacaccgattaacgaccaagttgaccgttatttcgaacgcctaaaaaccgccgatgaaattatttttattttcccaatttggtgggagctgatgccggcgatgaccaagggtttcattgataaagtttttagcaagaaccgggcggtatccatgcatcccagagtggtcctggaaaagaatccaatcatccggatcttcacaattgccggcacaccaacgtttctctataaactcaaatatggtaatcccattatgaaggccttggccacgggcacattcaaaaagatcggtctcaagaaaatcaagtggcacaacttcaacgctgaagatgaatcaccacaaaagcgccaggcggatttggcccacatccaaaaatttctgtcatgatgactgcccagtcctataatgaatgttgggggtgagtggatgaagtcattgagtcaaatcatgagtcggacattactagtgacagtgatactcactgctaattttgcgatttgttctgccaacaacactccttcattaggctccaccattcatctcacgaccacgcccaatgcccacgatctcggtgggattcggacgaaaaatggtcagcacattcgccaaaatcgactcatccgatcggctgcgctaacccgattaaatcatcacgataaatggctactttataagcagcacgttaaggtcatcttggatttccgctcaagtggtgaaatcaaacgaacaccagatgccaaaatttctggggttcgtcatctccacctatccgtcatgagcagcccaaatttcggcgtccacacgacttctcagtatgccggtcagttagctgccaaacagccaaattttatggaacaattttatcagaaaatggttcttgagtcccactgtgttaaggcttatcgcacgatgtttcattatctgctcaagcaaagatccgatgcgattctctatcactgcacatatggcaaagatcgcaccggtgtagcgaccatgctgattctttcaagtcttggcgttcccaaaacgaccattatgaaaaactatttggcatcgaaccattatctgaagaaaacgacggccaaagaatatcgacagatggcccgttatacgcataacccaaccgtgctcaggaacctgaaacgttcaaaaaccgctcgatcagcctatttgaatgccgcctattcagcgatttaccactgtgatggcacaatgaagcattatttacatcagcaaatgcggttgtcgaatcatgatattcggcaattgcgaaaccaatatttgacgaaatgagaggcccggacacaactaattgtaagttatgtctgggcctctctttagctccactgttatttagtttaaacgtgtgaaagaggacagcagtcgaaatttaagccgcttcagccgaaaacctgactcggtttcctggtgttttactgtgatttggattaaacgtgtgaaagaggacagcaattgaaatttaagcgccgccagccgaaaacctgactcggtttccgtccagcggcgcttaaatttcaattgctaaacgtcctctttcacactctacactctttttttagcatacaaatcaatctgcttaattaaattccgattccgattaaatcgggcgaacgcaaaggcgtcactaataagttcggagaagcgctgggttttgccattgaccgaatattcgttatccgccaattgatactgagcccgagccacataaaaagttacgtgccgatccgaactgagattaatcaaagactgtagcagcatattactgatctcgatttcatttctggccgcataaaaattgccggtgtaaaacagcatcgtcaatgatttccacaccgaatcaacgtctttatttgcattggtcttcaaccgttccggcatcttggaaaaataaaactcagctttgtcaaaattgccagcctgttggtaggaaatccccatccccacgtatgccagcggtgaataaaccgtcgtgtgggcctcgtcatagccattcaaaatctggtcgaagcaaaaaatcgcctcatcaacatctcgtttgcttaaagccagtgcatatccgcggataaataaatattccatttggatttgtttatcatcaatttgatcaatttcaagcgatcgtaaaattcccaacgcatcatcatattcagtggtaattaaatcaaattcggcccgccgcaattccgctcgaaccgctgaatcactgtcggcctcgctggggaaaatatcgttcaaggaaagtcccaaccgctggcataactgcgtcaggatcttagtggagatcattttgccgttgttctcaaatttgctgatcgtggcctgggtacaaatccccttagccaactcgctttgggaataaccgagttcttttctgcgatcaataaatctttggatgttcactattatcaagcctcctggccgattcggataaaataataacttaatattaccatattatataatgtgacgccaaataagattgctaaatattccatttatatattgacattaggaatattaggatatataattttggaatataaagtattgtgaaagtatgcacaggaggactcaatatgtcgataacaaatgatcaaactaaaatgctgattcaaatgattaaggagtttacggccaacgaattggcaccgctcgatatggagattgatcgtgccggtaactatccggacggcttatttcaaaaggtcgttaacacgggcttgcttggcatcaccctgccaagagaatatggcggtgcagcctttgattaccaagcagctgccgaatcccttgagaaaatggccacaggtaacgccagcatggccgtaactcttgaaggccatttcaaaacgatcgaacagtttatcaaatatgggaataaatcattgaatgacgaataccttccaagtgcagccaaacgaatttttgccttctcgatgaccgaaccatccggcggctcgaatcctaagggcatcgccactcgggcaatcaaacagggtgacaactgggtgatcaccggtgacaaaatcatgattaccaatggtggcctagcagaagtctactgcgtcctcgctaagactgaggatgaccaaatggccgtcttcgtcgttgacaaggacatgccgggattcaaattcggcaagcgggaagattttattggcctcaagggcgtgcctgtcggcgaagttgtccttaaccacgtggttgttcctgatagtcatttattgggaagaatcggacaaggattggaaattggcgacaatgcccacgctgacgcacgagttttgatgggcgccgttctagccggaattatggaacacgagctacaaaccgccgtgaactactccaaagagcgaaaggctatggacacaccgctctaccaactccaagtcactcaggaaaagatcgctgatatcgcaattgccaaagaaaacaccaccgcgctgtatcagaaaggtgccgataacaaggtcgccaacaagccatatgcggaagttgccgccatggcaaaatcgtacggcagccgatcagctgttgcatccggtgataaagccctgcagattcttggcgggtatggatacagccatgaatatccagtcgaacacctcatcagagatgcccgagcaatggaattggctgaaggtaccattgaaaagatgaatttagaaattaccaacgcagagattgccaagtaaaggagtccgcactatgaaaatcgttgtcgggattaaacaagttccagaaaccgattcagttaaaattgatccaaacacaaataacctggttcgttcaggaatccagggcattattaatccatttgataaaaatgcaattgaagctgcccttcagcttcgtgatcaagccggtggcgaagttatccttctcagtatggggccggatagttacacaacctcacttcgagatggaatggctatgggcgccgaccgggctgttttggtgagttcccgggcattcggtggggctgacactttggctaccggctacacgctggccaaagcaatcgaagcaattggcgatgtcgacttaatcctattcggcagacagtctgtcgacgctgacactggtcaggttggcccgattgtggcggaattcttgcagttcccccaagtgacttttgcagaaaccttggatttggactcagagaagacactggtggccaaacgccaacttgactccgccgtccaagatatcaagctgaccctgcctgctgtggtgactgtccgcaaagaactcaatacgccgcgttatgaaacgccagtcaatatcaaagaaagttttgaaaagccaattaccacttggactgaagccgatttgaaccttgacctggcaaaaattggccaggctggatcaccaacgaaagtgaccaaagtttatgcaccaaccaaggatgttaaacaaacagtcacattgtcaccagaccccgctcaagcagtttctgaactcttgagtcaattggactgagaggagcacaaaaatggataataacgaaatttgggtatatgttgaaaccgtcggctccagaatcgaaccaaccagcctgcaattgatcaccaaggccaaagccattgctgacggcagaaaagtggttgccgtgcttcctgaagcctcgacaatcaaggctgaaaatagcctacaagcttatggacccgaccgagttgaaactttggtcgatgatcactttactaacgcaaccgatgaagaaatcgctgatgctctattccaagtacttgatcaaaatcgccccaacagcctcttgtttccggcaaccattttaggccgatcaattgcgccgcggctgcaggccaaactccagactggcttaaccggtgactgtttggatattttttacgaaaatgacctactggttcaggtcaaaccgacctatggcgacaacgtgatgtgtgacattgtctgcccggaaaagcggcctcaaatggtaacggttcggccaaatactttccgtgctgaaagagtgactgattcccagaccaaggtggttaaggccagctttaccttccacaaagaaggaaacagccaaatcatcgccactgacccgatcatcaacagctcctccaaactcgacgatgctaaagtcgtgatcgcccttggccgaggcgcttacagcgcaaaaaatattcaactggcacaggatttagctgccaagcttggcggaatggttggcgtttctcgccctctcactgacgaagacgagttcacccatgatgatcaaattgggattggtggcgccagcctctcagccgacctgttgattaatttgggaatctcaggtgctgttcaatacacggttggtatcaaaaatgccaagaaaattgtctctgtcaacattgacaaagacgccccgattttcgatgagtcagactttgcctatgtcggtgatgtcaccgattttttgactgctttaactgctcaagtccgataataattgataacacaaaaccggcagtgatgaacgaaatttgttcatcgctgccggctttgtagtggtgtagttagggttattttgctttgaaatggattctggcgcgctggagcacggttgttattctctttggtgctcccttctgctttgaaaacacgctccgacgcaactgatgcggtgtgtaaggctgaaaagatttaaatccaagaccaggattttaatcttttcagccttacacaccgcatcacccgttgcttgtcgcgctctacttgaatccctccgtcgtaaagtaccagtgaaccttatctcccggtttaatcaacttatcaccagctgacttatcaacgtacttgccgttcaccgagtacatccagccgctgccgaccttaatgtcgttttctttcagcccattgatggcactgacgtagattgccgggctactggtgtaggtgatcttcagcttggtttgctggagcaatgtaaacgcggtcgtcttcttaataatgtgcaaattgccagaataaaacagctttttgtatccggaaacctttagataagccttaccagttgacgctggtgaggctttttgctttggccgagactgcttagaagtcgatttaggcttattggttactgcctgttttgtctgtgatttcgagctcgaactgctgggcttgttactggtaacttgactacttgacgacgagtcagcagtgcttgattgactggcctttttggcttgtgattgatgctttgcctgggaacctttgtctttggcttttctcgccttaactggatggctcacttgagaacttgaggtggcctttggctgactgcccgaatccatcttagcggctttctcggttcgaggatgctgggcggcctgatttgcgatgacctccctgacgccaaatgccatccccaacaccaaaatcacaccaatgacaattccaattgcttttttcataaactcatcctttaatcttacttaattgaataaaccgatcggtgtgccaaggcttgccgataagcggcgtttgccaaattgacctggccgactcctaacgtttgagtagcagcccccttaatcgagccggttgaccgaacgtagctcatcattgcccgcattggagaggtagtctggcctgatttgaagacgctattcaccaatttgaccgtcttttgtttggttgagaaggcaatgatcgcttctgcagttgaattagcgttcgggaaagtcttgcccttataagcataaccaaacgccccgtttggatagacagcatctttgagataactctggcccttcgtgattgcagacgtgacggcggaactggtcgatttactccgagcaagggccgttactgccatcgcggtggtgtcgctgtcagcactggcagcttgattattatacgcccagccattattgctcaactgattcttaacgatggcgttgctcaagctggtcttggaaaatttggcattgcttggtcgttgatacgaaccagttgataaagcaatcagcgcctggctttgaacgttgacagtttgcttggtcatcgaacggtgataaagcgcgctgaccaggttcaagttcgttttagcgccggtttgatgcagcttttgcgggttcaaaccaacggcacgggtggcaataattgcggtcgccaaatcggcagccgtactcttacggttcaataccaaactgtcggcaaccttggtccgttgagccttggtaaatttgtagcccaaccctttcaatcccaagagaaagtccgagtagccatagacggcaccggttgttggatatgcctttttactaaatatgtaacttgtcttaccagaaaagccagttcgattcttagccagcatcttcttggcatagctgtaactggccttggcctttgaagcctgataagaactagaagcagtcttggcgccggcagcatggacatttgtgagtggtgcagcagcaccagccaataagaggccagtcatcgataaggtgattaatttcttgattgatttcatgatagattccatccctttaatgagttttggttggtaaaaaattatatttccgattcagtcggtcaattaatttttcccaggaacgatacaacaatgcaattaagacaacgttggaaagacagtgcacaagatcgaaaccggcgctggcggtaaaggccaaaataaaggacttcatggtcagcggattgacatatgccaaggcaaaccacagatccatgatccagccgtagacaaatccccagacaccggcaaagataatcattggcattaccttgtggcgaagctgagtccggccaatcagcccggcagtcaagcccatcaatccccaggcaaacatctgccacggcgtccaaggtccctgtcccaagaacatatttgaaactaaggcggtggtcgagccggtcacaaaccccagctccggtcccagcgaaatcccgccgaggataatgacaaagctggcagcctgaacactgggaagcgaggcgaacggcactctgccggcgaccgccaaggcaatcagaatcgccaaaaacattagcgtttgggtctttaacggctcgcgctcaaaccgccaataggccggcaaaatactacataacaaaagcatgaagctaaacaacaaaaaatgcttatttttcagtaacgtcgtcaataccaaaaacccggcgatcaacaccgagacgagcaatatttgaccgatcactttggctcgccgcttattcgacatgttcactcgtcccttcagataatctaacgtcactcaccagcattgcatcgggcacctgccttctcagcagccgattaatcgcggtggtaaaaaagaaattcccagaaaaaaacgatctggttggtaagactgtgttcaaatggccgtcaaacatgaaggcgcagtgcagtgagtatgccgcgcaaaattccatatcgtgactggccatcaggatggtcgttccagcctggttgatggtcgtcaataactgtcccaaagcttgtttggccatcggatcaagccccttagtcggttcatccaagattaacaatttcgggttagccagtaacgcaatggcaatccccaacagctgttgttggccgctgctcaaatcaaatggactttggtcaagcagatcgttaagttgcaatcggtcaactatcattttaacctgtttgtcgggaaattctagctgaagttcggcagcttgctggtgcaactcctcttggaccgtttcagccccaaactgcagggccggggtttgagagagaaaagaaagctgctggattctggctgctgttggaatccgccagaccttttgattgttaaaagtaatttttccatgctgtggaactcgcaagccagccagcatcgttaacagcgttgacttgccagagccgttcttgccgacaatcgaaagccagtcgccagcaggtaattgcaagttcaaatgatcaaccacatttacctgtttgtcgaatgaaaacgagatctctttggctgctaagatggtcgttgacgactcgacgaccatcggctggtccgtgtgagcggtgaactccaggtggtgcttgctgatagctgcctgaccggcggcaacggaaattggcagcccggttgtctcaagatgattatccaaaaatagccgcgacacagctggcacaaaagccgccagatcgggatctgtcatcatcttcggaatgccgactgccggctgcccttgaaaagtaacccgctgattttgtaagaggatcatccggtcagccaatcccaatgcggttcccaagttatgctcggtcattacaatcgtcattcccagctcttgatgaatccgttccaaaacatcaaaaaaatgccggctggaaagcggatccagttgggcagtcggttcatcgaacaaaagcacttccggccgcaaaattaacaccgaggccaaattaaccagttgcaattgaccaccggacagttcatgcatatcttggtgcagtagttcgtccaggcccaaataattagccaattcggcgatccgccgttcaatttcagcgctcttgataccgatattttcaaggccgaacgccagctcgtcaatcaccgttgtcataatcggctgagtagtgggatcttgcccaacgtacccaattgttttagcgctggctaatttggaaagatccgtaatggcttgctgcttaaccaataccttgccgcttcggtggccattggggagcagttcttttttgaaatgattaattaacgtggttttaccgctgccagtcgccccggcgatgacgataaactcccctcggttgatggtcaaattaaccccttgcaagactgggatggaagcatcgggatatgtaaatgtgagctgtctagtttcaattaatttgtccatgcgcgatacactccttcggccgccagcggtaataatagtaatcctcccagcccggataaggcaaccagatcctggctcatccagccacgggtgaattcgccgactgatgtcgaccaaccggctgactgaattcgggaaaccacggcccagacaaaaatcaaggtcgacgcaatcataaatgcccagtcactgaccttccaatggtaggcccggtagtgagtccgcttaccaaccccgaatcccctggcgtccattaatcgggcagtttccatccccgatgcgagtgcgtcctccaataaaatccgcaacaggcgaccagcattccggatgcgactaagtaccccgccaccgttatcctgaacgtttcgcgtctgctggagcatcgccaaactagccagggtgtggctaaaagttttcactaaattcattgacataaccactaataagcccagtttcggcgtcactggtgacaagacatataccaatttaggcgccggtaaaatgacgttcagaacagcaaaagccatgagcatctcaactaacatcaaccccataacgacaccgtatagcagtgccggcaaggtgagtttgaatgacacatcacccacggaaaactgacagaggatcggcccaaaccgctgatttaacaacacattaaaaaagacgatcatcaataataagctcaaattccacttgaattgccgccataccgctgattgtccggtataaaaaatgcccaccaacagtaatcctacataaccggtcaatgccgtcgccaaatggttaaacaagagcagactcaaaatcgcctcaaaaaaataaactgccgaaacgactggatgaagttgatataaaaatgtcattcgtgtcggcaatttattcacggctggacgtcccctttcaaatcgatgttgaccctgagtgattattatatcatcagctgccactcgaaattgaaggaatcccagaaaatatttaattaaagctaatcgacaacaatcacacccagcatagcgacaatctgccctgcctgccaaggattgatttttaagcccttgatcaactcgggattcacaattaagtcgtcaaagcgggcttgagacaaatcgatccccttcattcgcgtgtccaagaagtcgatttggttaatttcacaggcgttaaaggataattctttcttgacactcactgcctgaaaactactttcgaccagattacagtccataaagaagctggcttccattttagtttcactaaagttggcatagtgcaggttagaatcatgaaattgacatttcttaagcagcgtttccatcgaaaaatcagcccccatcagctgcacattcgtgaatttgcagttggagaaataactcttgtggaaagtcgcgtttaggaaattgcagcctttaaattccacgtagccccaatcactgccgtcaaagttgctctgctcgaactggcagtggtcaaacacaacgtcattaatccgaatcagctcgttagaaaccgtcaacgtacagttcacgtattcattgtccggttcaacgtcatccaaagacaaggtttgtttggtaaaagttgccactctaatcctcctgaagttgactgcgactggtcaatcgactgccgacccaataaatgacggcagcaatcaacatcgaaatgaaggttgcgccgactgagtccgccaacacggccaccgttttaatgtatccgtatgcaaggacagcgatcagccatgaagcaatcgcaatccagttaataccaccagtataccaatattgaccggtccgggaggcaaaatggtcaactcgatatttccgtttggcaaccagataaaagtcggtcagaaaaatggcgatttcgggtcctaagaacatcccgatgccgtccaaaaaggcagtgaaaacgttcaggaatgttgagtagaaaatgggaatgaaggtcacaaagacggccaccaaggtcaccagcacaatactgacagtcaaggataatcgtttagtcatattggtcaacgcagatccggcagacatcaggttaacggcatttgcggtggtactggtaatgatgatgacaagcatcgccaagacacccaagccaagtttgctggcaatcgttgatgggtctgaattattggcatcaaaatgattcagggtaatggcagtcgcgatcgttgaaatgattccgatcatcgcaaaccagatcaatcccagattggcgccaaagaacggtgcccaagtggagctggaacgcttcttagaaaagcgggtgaaatcactggcagctgttacccaggctaaattaaaggcagctaggacatcaacggcttgacctggtgacatcttcaaggcactgggtgcatgccaagagacaatttcagataacgacacattttggaaaacaacgatagattcccagattaccaagatgaaaactaagacaatcccaattcgctcgatgatccggactgatttttcacccatcgagatactcaataaatgcagaatactcatcaccacaattcctgagatcaaccctttcaggccgcccggcttgccgtataccggccaacccaagacatcgtggagaatataactgatcgatgtggccgcgataaacgtattcacggcggcccagccgataaattggacgacattaatcaccgatggcaggaaactgcctttgaggccaaacgaagctcgggttaaggccattgcgggcaaaccggtttcgtaccccatatagccggataatgccagtaaaaaatatgtaatcacacctacgataatcagagtcgtcgaagccgtcgcaaacccacaagcagcgataaccccgccaacataccaagtaccattattcgcattcgcccccacccaagtagcaaacatatcccaataggattgatgccgatgagcctttgggatggactcaacgcgaccgaaacttttgtcttccatgatagatctccttgttgtcctttaaatcattccaagcaaactaaaatgctcattagcaaataaaaaagcacttcaacccacaacgagtcgaagtgctcattcccagactattgctggtaaaaacaacgttcactaatggcttccttgacagactcgctggactatttaaaggactaaattttaatgtcattatacgtgagaccggcaagaaaagcaatttgtgagttgacactcactttgaatggggtatgctgaagtcgtaaatgagttagcactcactcacaaaaggaggaatcaactatggatgctgttgtaacagtgactcacgtcgataaaagcttcaataaaaaacgaattttacatgatgttaacctaactgcctcaagccatgagattttgggtttaattgggccatcaggagctggcaagacaacgattatcaaaaatatcatgggcatggaacagcccgacggtggcgaagtgactatttttggtaaacgaatgcccaatcgccccgtcctgcagcgaatcggctttatggctcaggatgatgccctatatgaaagtttgaccggcaaggaaaatctcaaattttttgctcaactgttcggtgtcaaaaaagagcagctgaagcaacggattgactacacggcaggcgttgtcaatttaaaccaggatttggacaaacgggtcagtaattattccggtggtatgaagcgccgattatcacttgccatcagtttaattcaagatccggatttgttaattttggatgaaccaacagtcggcatcgacccggaacttcgccgccagatttgggatgaactcagaaaatatgcccaagccggcaagtcaattatcatcaccactcacgtcatggaagatgcggctgaatgtgacgaactattgatgattcgcgaaggtcacatcatcacccacgggtcacccaccagtttggaaaaagaatacgacgtggataatttggaacaggtctttttgaaagcggggaaatcaaatgagaattctaacaatcactaaacgtatctttgtggaaatgttccgcgataaacgaacgcttgcgttaatgtttattgcgccgctgttcatcctgtcattgatgtatttcttatttcagtcaaataccaacacggtcgcagacatcggcacctataatgtgtctagttcattggtcaaaacaatcgacaacaagcacatcaaaattcatcggatggattcgaatgtttcagcaaaaaagaccattcgtaacaaagactacgccggtttcatcaaaaaaactgatggccacttagtcgtcacgtatcaaaatgccgatcagagtaagaccgcgatcatcaagaaatcagttcagatggctctgataaaagttcaaattaagcagctggtttctaccacgaaacagtccaaagccggcttaatgaagatgcaagctcagctccagcaaattaaaaagcagctgccagcgaccctcagcagtcggattccggcagcgtccgctccaaaaaacgtccaaaagccaaccaacctgaaattaacccagcactatctttacggcaagagtaattccaccttcttcacaacgatgctgcctgtgttcttgggcttcatggtcttcttctttgtcttcctaatttctggaatttcactgttaaatgagcgaaactccagaactttggaccgactgctggcaacaccggttaaacgaagtgaaatcatttacggctacctaaccggttatggcgctgtggcgatcattcaaacagcggtgatcgtgttattctgtatctatgtcttagggatctccattcttggcagcatctgggtcgtcttattgatctgttttgctttagcaatggttgcgctgtcgatggggctgtttgtttcgacctttgccgcttcagaatttcaaatggtccagttcattcccattgtcgttattccacaaattttcttctcaggtttgatcccagttgccaacatggcaggctggctgcaggttatcgcccatatcatgccgctgtattacggggccagtgcgttaaccgacgtcattcaaaagcaggccaacttttcggcaattgtcccacaatttacagctatcctagcattcttggtcgccttcattgctttaaatatgattggaatgcgcaagtatcggaaagtgtaggtgattaacatggcatcaacttcgattcagtcattttattcggaagatattgattccacttattcggaagatattgattccacaaaagatttaccccaaaaacaaaaacaggtgctgaaagcctgcttggacttgtttgcggccaaaggatttgaagccacaacgacggcggacattgccgaaagagcaggcgttagtcaaggcacggtttacaaacgattcaaaaccaaagaacagctgctccaagccgttgttcagccattattttcgcaaaccgttcccagagctgcccaagagttctcagaagacctcaagcgtttcaagtacgatagcttggcagaattcttaaagccgactttaaaaaatcgattgacctttgccagcgaaaacaagcaaatcctcaaaattttatttatgcaggccgtcaacgatccccaattattgtcagaattggtcgttccagttaaggctgtgctgaccaccactattcctaaggtgattgatcagctcaaagaacgccacctcttggtggactgggagacctcccgaattttggagtacgttctttcaattggtgccggctttggtgcccaaattatattacttgatcggaaagtcgatttggaccgggatattgaccaagctgtcgagtttttggtcaagggcctttcgccggataataaataatttagcatatcaggttgacaatcattagaactacgactagtattatcactaaattttaatgctagtaaattaaagctctgaagagaagagtaattagtgaacgaacccttagagaatccggtcggtgaaaaaggatggttcataagctaacgaacatgaactctgaatagcggtttcgagttaacgcttgaaccccgggtgcgaccgttacatcgccgagtatcgaagtctggtactttcagaggtgttggttgtgaggccaagacaaattcagggtggtaaagcgaaacattcgcccctccgtcagattaattctgatgcgagggacggatgtttttttgtgtcctcaacttcggatggtgatattagcattaaaaacaaattaaatgttatgggagattgatcatttatggcaaaagttgaaagttttacattggatcacacaaaggttaaagcaccgtacgttcgtttaattaccacagagaccggccccaaaggagacgtggtctcaaattttgacctgcgattgacccagccaaatgaaaccgccgttccaactgccggcttacacacaattgaacacttactggccagtttactgcgggatcgcttggatggcgtcattgactgttcaccattcggctgccggacgggatttcatttgattacctggggggaacacagtactaccgaagtcgccgaggccttaaaaggttcattggatgaaattgccaaccaagttgaatggaaagacgttcccggcgttgataaatacagttgcggcaattaccgcgaccactcactgttttcggccaaagaatggagcaagaagattttggctgaggggatttccaatgacccatatgagcggcacgtgatttaggggtttgtgaaacgtatttgtttcgcttaattttagttggcaacgagtcttcatcaaaaggcattgttaaataaatgctgagacctgctgctggcacactcacttttactttgatgaaacgtgctctttggggcagcaacctgcacctaaggcaacttgggacaaaatcaaaatcgattttcccccaagttgccttaggctccggttgctaaccgccccaaatcgcactctaggaggatacaaacacatgacaaccaccattatcggctttccgcgcatcggtcaccatcgtgaattaaaatttgctaccgaacattattggaagcacaagattgatcaaaatgaattactaaaaaccgcttatcaaatccccaagaatcactggcaggcgcaacaagacgccggcattgacctgattcctgttggggacttctcgttttttgatggggtcttagacaccgccaacctcttaaacatcgtttctgaccgctacaaggccctcaacttatcaccgcttgacgaatactttgctcaagcccgtgggtaccagaacggttctgaaaccgtcaaggcgctgccaatgaagaagtggttcaacaccaattatcactacatcgttcctgaattcactaagacgacggacattaaattagtcggtgataaattatttaatgaagtcgacgaagcactcaaattagggatcaatgccaaggccgtcatcaccggcccttacacactactcaaactcagtcgtttccttgatgggacgacacccaatgactttgttgatgccttgattgctgcctactcacaagtcattgagcatctaaatcaacaaggggttaactggattcaaattgacgaacctgccctaagcttcgacgtcaattcagctgaaaaagccctttttgacaaattgtatcacggcattctggctgccaaaggatccagcaagattctgctgcaaaattactttggtgatatccgcgacatctatcatgacgtcaccagcctggattttgacggaatcggtcttgactttgttgaaggcaaatacaatctagagctcgtcaaacaaaacgacttccccgctgacaaggtattattcgccggagttgttaacggcaagaatatttggcgcaaccattacgcaacaaccatcgacctgctaaacaacctgaatacggacgccaaagttgttttgagttcctctgcttctctattacacgtgccatacagtgccgcagatgaaaccaaggtcccatcagacgtcaaacagcacttggcatttgcgattgaaaagcttgccgaaattaaagaactggacaccatttaccacgatgaagccgacggtaaatcagcgctcgaaaaaaatgacgcccttttccgcaacgtcaaacatccctacaataaatccgtccatgaacggattaacaatttaaccgatgatgactacacccgtttacccgcccgaagtgaacgcgaaaagattcaaaaaaaggaattcaatttgccaattttgccgaccacgacaattggctccttcccacaaaccaaagatgtccgccagaaccgggcaaaactccgccacggtgaaatcaccaaagcagaatatgataaatttaatgaagataaaattcgccgcatcgtcaaaattcaggaaaagattgggctcgacgtcctggtgcacggtgaatatgagcgtaacgacatggtggaatactttggtgaaaaattagccggctttgtctttacccaaaacggctgggttcaatcatacggcacccggggtgttaagccgccaatcatctggggtgatattagtcgaaccgcaccaatcacggtgcggcctcagtctttgccaaaaatttaaccgataaaccaatgaagggcatgctaacaggcccggtcacaatttttaactggtcgttcccacgtgaagacgtgacgccaaaagaatcggtgacccagattgctttagccttgcaagatgaggtcttggatttggaaaagcacgacatcaagattatccaaatcgatgagccggcactccgtgaaaatctacccttgcgaaagtccaactggtactctgaatacttggactgggcagtgccggccttccgcctcgtccacagcaaggttcaacccagcacccaaattcatacccatatgtgctacagcgaattcggtgacatcattaaagccatcgacgctttggatgccgatgtgatttcctttgaagcctcccgtgccgatttcactttgatcgatcagctggtggccgccaagttccaaacagaagttggaccaggcgtttacgatattcattcaccacgaattccttccgagcaagaaatcgaaggcttaatcaagcaattagttgccaagctgccagtggataaagtctggatcaatcctgattgtggtttgaagacccgctctgaagacgagtcatttgaaagcctgaagaatatcgttgatgccaccaagaaggttaggagtgagatcaatgagcctaacagcgttgtttaaacaaaaaaccgtcttttcgctgaaagtatttccacctaaaaaggactccccaactgatgcgatcctgccaactctcaaacgacttcagtcactgcagccggattttatctcggtcactttgggtgccggcggaaccaatcactgtgatgggactgtggcagtggctgatttgattcaaaatcagctcaatatcccggcggtttcgcacgttcccgggctttatcagagcaaggaccaggttttggcacttctggatcgacttgatcagatccacgtcaaaaatatcctcgctcttcgcggtgaccgcatccccggcaaagaaccggttggcgacttcaatcatgccaatgaattggtcaaatttgtccacgagcagcgccccgatttcagcattgccagcgcttgttatcccaactgccacacagaggcagccgactttgtcgatgacattagccacctcaaggaaaaagtggctgccggagccgatcacttaatcagccagcttttctttgacaatcaagcgttttacgatttcaaggaaaaaactgagattgccggcattaacgtcccgattgaagctgggatcatgccctgtaccaacaaaaatcaaattgagcggatcacccaaatctccggggtgccgattccaaagaaatttgccgcaattatggaccgttaccaagacagcaaagaagccatgctggatgccgggattgcctttgcggttgatcaaatcattgatctggtctctcagggagtcgatggtattcacctctacacgatgaacaagtcgaaaattgccaagcgaatctgggaggaaactgaatcagtctttgctgcttccaacttagccaagcaaaaagcaaatcaaaattaaaaaatcgctgtgtcagcttaaccggcttgaacgattaagtggcacagcgatttttttggaggagtggttctggtttagttcgcatgggcaatcatgcgtgaccgttggaaaacgcgtccggcaaccactaaggcaatggctgtcgccgcaattccagaggtaaagtaaagacgttttcgcttcatagatgacttcctttcctgtagcccaaatgacaatgccttgtagaagaatcatatcttggaggagacaatcttcaatctcattgttggcactttaagtcattggctgcacttatcatggtgacaatcagttactgatcccttctttcttatttgattgtccatagattacaagggccagcttaacccaaacttaaagttgggccaatgtggcttttcaagcgatcacctttaaacaaacgcaaacaactttaaacattcataatcaaatcagcttaatcgtactggcgcaaaaatgtggatagccgtttcagaccttccctgagtgttgcttcatcggcacaatatcctaagcgaacatggccaggcatatcaaatcgattgcctggtaccagtaagacgccggtctctttgagcaggcgaatacagaagtcttcaatatcttccggcacatccaacttgggaaacgaagttgaaaccgcttggggcatcacgacactggctcgaggttccgagtcaatccagtcacgataaattgccagattattcatcaccagctgtcgatttctcgccagaacttggtcacgatgcttcaaaatgtaggtcgccatcaaatcattaaagacgccggcacaaatcatcgtgtaatcgcgatacttgcgaaagagatcggccacagtcgcatttgaagccgtccagccgattcgaattcccggcattgaataggtctttgacaaagaattggtcgcaatccccttgtcgtacaagtcgacaatggaagtaaattgatcgggatcatccaatggcaaataaacctcatctaccaagacgtaggcgtccacctgccgggccaattcgacaacttgttgcaaaaatgccttatccagtagggttcccgtcggattgttggcgttgttcaagcaaatcatcttcgtgttgggtctgatcaatgattttaattcgttaatgtctggataccaattctgatcctcatggatatgccaaaaatcgacgttggcacccaaagacttagggatgtcatacagctgttgataggaagggtactctgaaatcacgtggtcgcccggctcaatcaatgcgtacaatgccaaatgattggctccggtggcaccattggtttgcaaaatgttgtccgcgtcaatatgggcgtacagtttagcaacttcctgtttgaattcaggtgagccttcaatccagccatagttcatcttttcttgatccagttgttgagaaaatgatgcgccctgctggccatcaagtgccagggcttcttgcatcgtcattgatgaaatcgtgctttgagaaatgtcataagttgcggatttctcccatttatttaaccattcttcaacgccaaatccagcaattttcattgatcttcactccttcaaaatttgaatgattcagattaaatattaagaattgcttaacctttcacaagggtcgggacccttgatgtagcaaggccttattaacctgtttcttatagcgaacatttgactttagttataattatgataagatgaaagtggggataggttgatgagccggtgcatcaatccgcattgtcgtcacagtcagtaaaggagatggcaaccatgcttagtttatatttgtcgcctggcagttcatcgtgtcgacgggcaagaaagtggctcaccgaccaccacattgattttgtggaacgagatatctccaaacaaactttgaacgcagatgacatcaagcaactgctcagactgtcggaaaatggcactgaggacctgatttcaactcgttgtcacagttatcgcaaattaaaagtcaatttcgataatcttactgtatcacagttaattgacctgatggtaaaatatccagatttactcagaaggccgctgatcttcaatgatgaacagctccaggttggctttagtgaggaaaacatccgcagcttcctgccacgccaaaccagaagagaaatgctcaatgatatgctggcacatgccgaggctgtcggaatgagctaaaaagttaaagtttgcctacgggaagcgaccgtgcttgttttccactacccctttgaaatataatgtttcaaaggggtgttttctatgactttactgataccgaccgcgattatcttcatcgtcctggtcggattattctttacatacttaattaaactgagaaattccttatatatcggcaccctggcaaacttatcgctgctggttctgctggtcttgctggttgaaattatctcggtcctcaacagccagttctggggcatcattttagggctggcggttgctttggttggcttactggttttcttggggttgacgttaagcttcatcttctttttcattaacgcctttattgtgtggaaacgtgaaggttatagcctcagtagttcgctgaccttgattaccgggattgccgtcatcgccgttgacctgttattcttcttcaatccatcagttgggcccaaaccgcttcaaggggccatcacgatgtttttgaccttgctaattggctacgtcctattaacggtttggaatacgatttcgtcgatgatcttataccgactgtactttccacgaaaagataaagattacattatcgtcttaggaagtggtttgatcgacggctacaaagttggtcgactgttgggcaaccggattgaaacagctctttctttttaccgaagtgagatcaaagccaccggcaaacacccaaagctgatcttttctggcggtcaaggccgtgacgaattattgcccgaaggtgaggccatgcagaaatacgctttggaacatggcatcccgaaagttgataccttggttgaagataagtccatcaacaccgaacagaacttagccttctcccggaaaatcatcgaaaaagacagcggccgagacgacaataaagtgatttttgtctccaacaactatcacattttgcgggccggcgtgcttgcccggaagttgaaatttgccgcattcggtgttggcgcgccaaccccattttactttttgcccaacgcagtcatccgcgaacacctcgcctttctggtaatgaacaaacgcgccaatatcgcaattatcgttttgattgccttaattgcccttggaaccgggctgttactctattttgtccccggtgagcccattcaataaaataaagtttaggagatttccatgtcacagtacattcacgttatttatacggctgcaattatttttccaattctagcaatttttattaccttaccgattctgttagtgaactaccacaagtatggcgcaattcccaagtggagtatttttatgctctacacatttgtcttctacatgatgtgcgcctactttctcaccattctcccattgccaagccaatcgtttgtggcccatttgacgaccccgactcacaatttcgtgccgttcacattcgttcgggagttcattaaatacaatccgttttcactgacgcatcccggaacgtgggttgcggccttaaaagcccccacggttatccaaccggtgtttaatatcttcttaacggtaccatttggcttttacctgcactattatttccagcggtcatggaaacagacaatcttattcacattctgcttatccctattcttcgagttaacccaactctccggtctttacggcatctatccccgtccttatcgactattcgatgtcgacgacctgctgttaaataccactggtgggatcatcggtgcttggggagcttccctgcttggccgttttctaccaaccaaggaacaggtcagagcccggacaatggcgctcagtaaaaacgtttcgccgctgcggcgtggagtcgctttggcggtggattggatcatcattggtctgctgaccaatattttgggcattttcctgattccacactggattggcatcgcgattggctttgtcatctttattctggtactggaactcagccgccagcagacgattggcatgcgcctggttggcatcaaagtgattaaccgtaatggccaaacagccagctggtcgaaaatcttaatccggaatttgtttggctacggggtgatcggtagcctatacgagattgtcggccggctgttagacatgacggcaaccgcccccaaagcccagttaaccagcattctccacgttgtgctgattctatcgtttggtctgctgctagtctttgtcgacttactgattgactggttctcacaaaaacacctgctgttctttgaacggttgagtgggacagataccgcgagtgtgggaaaataagcggttagattcacactattcgatgaaaccatattgaaaattagaatacaaacgggcctgagcaaaacagttagttttgctcaggcccgtttgtgagtgaatgaaagaatttaattattccttggttttaatattctcttgaataatatcatgcagccgttcgaacaagatcccctctcgcaggccgctggttgaaaacataattctgtctgaatccaaatagttcatcagtaaaatgacggggatcagaccgccgacaataatgtcagcccgttccttgttaatcccgggaacctttttgcgttcgtcaagattcatcccaataatgcgttcaaaggtttcattaatggcgtcatcccttaattgatagccgtggatgtcattggtatccaacagattattgaaacgccggttaatcttagccaaggttcgattactaccgcctaagccaataattggcaagttcaaaccgtttcgcagccaccagacactttggaaaattttgttaacgaaaatcattgctttaaagacttcagtagcagcaatgtcgtcagccaaatcgaattttgatgataaggtgactgacccaattggaatactgatcaggttactgaccttgccgttttgaaccaggacgatctcggcactggcaccgccggtatcgataatcaccgcattggttgccggcagtgtctcactgacaccaacgtaatcatagtaagcttcccgggtcccggaaatcacgttgaggttaatgccaatgtcatttttgacccgttttaaaaattgcttttgattggtcgcttgtcgaaccgccgctgtggccaccgcaacaatattgagatggtcaagcttggaataaatcgttttaaagttcttcaaagcgccgatggttcgttcaatggcttcgggctgaagaattttctcaacccccatattctcagacagtcgaacatattccttttcttgagcaactgtctcgtaggtgccatcgtcactgattcggctaatggtcatccgcactgagttggatcctaaatcaatcaccgccaaatttttcattactggttgtcgcccccatcttcatcattgaatggatcaggctgattttgcgggctcatcattggctgaaactgggccccactcttgggccgattctctccttgctgagcctcggtcaaccgagttgcctgagctgcaaagaattcttgagaatccaatggctcacggcctcttctgtccactcgtttgtagacaccgttcttatccaaggttcttgtcttgacgttatcattccacatggtggtgtagatgctgaccactcgctgggccaaatccggttgaaggactggaaacatctgttcaactcgtcggttcaaattccgagtcatcagatcggcactggcaagataaacttgttgttcaccgtcaaaattaaacatgtaaatccgactgtgttccaagaatcgaccaacgatcgaatggaccgtgatatgatcactgacatctttgatgccggtctttaagcagcagattccccggataatcaaatcaacagtcacaccagcgtgggatgcttcatacaatttggcaatcatatcctgatcagacagcgaattcatcttcatttgaacatgaaccggtttgccctgcttggcatatttaatcgcttcatccagtcgctcggtgataaattcacgaatcccatttggtgaaatatgcagttggtggaagtatggcggccgtgaataaccggataacatgttaaaaatattcgtgacgtcaatgccaatatcagtattgcaggtcaacagacccaaatcggtgtagaagtgggcagtgacgtcgttatagttcccagttcccatgtgtacgtagcgacggatcccattttcttctcgacgaacgactaatgacagcttggagtgggtctttaacccaaccaggccataaatcacatggcagcccatcttttccagctgacgggcccaatggacgttgttttcttcatcaaaccgcgctttaacttcaactaaaaccgtcacctgcttgccattttgagcagctcgtcccagatatttgatgattggcgaatcaccggatacacggtagagggtcatcttaatcgctaagacttcactatcgatggatgcctgacggataaattcaacaacggaatcaaatttgtcgtatggatgctgcatcagccaatcatgtttttgaatggcatcaaaaatgttgtgatcggagtctaaagctgccggttgataaggcttgaacggtcgatatttcaaatcatcatgaccgattactttaccagctaatttgctcatgaaggtcaagtcaagtgggccgttaacttcatagaccgaatcttcggccgtctggagttccttgaccagccgctttcgaagtttgctactgatggttgaatccacttccaaacgaatcacttggccgtgttcacgcaacttcagctgctgttgaacctttttcaacaggtcagaggtatcttcttcagcaacatccaggtccatgtcccgaatcacccggaagacactgacttctttgatcgtgtagttaatgaataattgatcgacgaattgcttaataatatcttcaattaaaataaaatcgttatcgccaccgggcagtttgatgacccgtgagaagatgctggggacttgaagcgtcgcatacagtgtcttgccctcctcatcatctttcttgttaagccgcagtgacaaattcaatgagtcattgttaataaatggaaacgggcgcgaactgtcatccgccattggggtgagcactggataaagctcatcgtggaagtatcctttaatgaactggtattgctcgggtgttaagtcacccacttttagtaaatgaatgtcgacctggttgagcgccggcaacaacgaccggtttaaggtgctgtactgtcgaaccagcatctcatgggctttcacgttgacgtctcggagctgctcttctgcagaacggccagatgaatctttgccatcccacttaacttcaaccaattttgccagtgacgccacccgaaccatgacccactcatcgaggttactttgggtgatccctaagaatttgacccgttctaataatggattgtttttatcccgggcttcttctaggacgcgttcgttaaaatccagccaactcagttcgcggttgttatagtatttgggatttttaaaatcaattttgtctgtcattttgcctttacacccctttgtttgagaacggctttataaccatatgcttcagtaaagaactgactcttggtgttgaagatccagttttcgtaggccagattggcattgctgaacgttgtgatgacaactttagattccttgattgaaaccgagatttttttaatcttctgctggcggtcgtcgtccaaggcatctgccaaacgcagaattgccgctaacttggcaattaatcgccggctttcagctgagatatgctgaaagtgaatcagatcttcattaggcgtcgtcgaactgtgatatctggcaattgcggcgatcacccgaatatcatcccgggacaacccaatgatttctgaatggagaataatatactcggaatgcaggtagtgttcatggatgccaacgtagttcccaacatcgtggagaattgaggcaacctgaagcaggattcgctcacggcggcccagttggtgcagcggctttaactgatcaaatagatgaagggcaaatttagttaccaaatcccggtggaccggctcaacatcatagtgtttggaaaggtttaaagccaaacgaataatctcgggtgtgaaatcccgttttgagtagccctgttccaaggcttcctgattgaccagaccatcaacgaccccagaatcggaaaacccgatttcagaagcattggttaatctcaaaatccgtctggtcaacagcagttccggcagcaccaaaggaatgtagtccggatcaacttggagccgttcaatcaaaaattgatcggaagcatccaccaagtcgtccactaatccagtgaaatcgctggcagtaatcgtgtcgctggccttagtgtgctcgtaattttccaccagccgttgcaaaggcagcgaccccagcaaaatgatcttggtgggaactttgctggacacgacgctggcaggattcccgatgtaaaagtcgttcaatttggaatcaatgtaatcgttcaacagcccaattgaattgggtgccgtttgccgcaggctctgcaagtcctcggcaattttgattggccccaaggcaaaactggtggagtcgacaaatttaccttccttgaactccgtaatggcagtatttccagaagtgatgcccaccaaaaaagtggtgcgcttatcgttttgcttatccttcgtcaactcaactgaaatgttttgatttctgaaataagtttcttcacttgttgaaagccactcaatattcatgccggtatgtaaaaagagctgatcggcaataaaatccgagttgagcgcttggtgaagggcattgctgccaaatagtttgtagttggtcacaccgtaatcattcaaaatttgaatgaatccggtcaaagcttcggacacccggttaacggattcgtacttcacgggttggtcctgatagacatcgtctcccaggttaatatcttttttgacgtgctcgagtggcttcaggttctttaaattcacgatcaacaattcagagccctgaacattcaccatcatcacgccataatactttactgccatcgttttcaccttctgtatggattccccaatcaaacacagctattcataaatctctcttatcaacgtaagtatacaatattttacagggtgctgacccatccgtatagcttggataacaactttttgtcatttttcgtaaaattgattaaccacaaacgattgcgcgtttgtttgattgacatcaggcagcaacggtttgaaaatagacctgtaccaaattattgtcagaaagaagtgtatttgatgactgaactaaatgcagcaaacgctggcacttacaaatttgatgatcaatttgtcgtcaaccgcctgggatacgggaccatgcagctgactggtaaaggcacttggggtccatacgctgaccctgcccgtgcagccgatgttgttacccacgcgactgaacttggaatcaacttttttgacactgccgattcttacggtccgtggttcgccgatcgctatctggctgaaggcttaaagggcgccgccaaccgtgatcagattttcatttctgataaggttggacaaactcgccaaggcccgggtatctggacacctcatggtgagcccaactacctgcgccagcaagtcgaagtttctatgatgactttggggattgatcacgaagacttggtcttccttcaccgaattgacagtcacttcccagtcgctgagcaggttggtgaactcaagaagatgcaggatgaaggtaaaattaggcatatcggcttgagccaagtcagtgttgatcaactcaaagaagcccaaaagtacgccaagattgacgctgtggaaaacctctataacgtttccaaccacaaggatgacgatgtggtggactacgcacaatcccaagggatggcctttttaccatggttcccactggacactggtcgtttaattggcgccgatagtccactcagcaccatcgctaaaaagtatggtgtctcagaagcccagatcgctttggcttggttactcaaacgttcaccaaacattttaccgattcctggaaccagctcgattcaacacttggaggataacgtcgctgctgctaatgttaaattgagtgatgaagactttgaagctttgagtcaactttccaaataatcccaataatgtctcactggcctgcccgatgatggcgggccatttttgtacatattttgcctgaaaatggtaacccatggagttatagctcgcctttctactttagaattgttataatctagatagaagattaaaccggattggagggcttattatgaacaaactaaccaactacatgcgtctaatcggcgtcttaattgtcgcggtgatcgccttggttctacaatttgggctgcacttgccgctttacgctcagattgttatctcaacgctggggtcactaattgcccttttgatgtttatcgacatggtgaaaactttacgctccgggaaatttggtgtcgacctgctggcaattacggctgtcatcgcaacgattgccgtgggtgaatactgggccgctctcatcgttttgctaatgttaaccggcggcgacactttggaagattatgcggccaacaaagctaactccgaactgcagtcactgctggagaattcgccccaatccgctcatttgctgaaagacgacaaaatggtcgacgtcaaaattgaccaggtcactgttggcgatcgaattgtcgttaagcctggagaagtcatcccggttgatggcaccattactgacggggtgacttcggttgatgaatcctctctaaccggtgaatcccgccccatcgataaggtcgttggttcaaccgtcatgtccggagcgattaacggcgatgcatcctttgacatgattgctgacaaaacggccgatgacagccagtaccaaaacatcatccgcttagttaaacaggctgagagcacccctgcccacttcgtgcggatggcggaccgctacgccgtaccattcaccttactggcttacgtcatcgccggagtagcttggtacctgtccaaagatccggtccggtttgctgaagtcctggtggttgcctcaccgtgcccactgattttagctgcgccaattgccttagtatccggcatgagccgtgccagtcgaaatgggatcattgtcaagagtgggacgattatcgaaaagctggccaatgccaaaacgtttgccttcgacaaaaccgggacgattaccaaggggcatttgaccgtcagccgggtcttcgcgatagctggttacaccaaagatcaggtcttggcgctagctgccggagccgaacagcaatccagccacattctcgcccgttcactggtggcggcgattccggatcaaattccgactgccaccaacgttattgaaaccactgcccaaggagtccaggcaaccattgatcagcaaacgattcgggttggtaaaccggcttatgtttccgatgacccaattgacccgcttgatcaaacggcagtctacgtatccgtcaatggcaaatatgtcgggtacgtggccttctcagatgaattacgaccggaagccaaggctgtgatggatagtctccatcagatgggagccacagaaatcatgatgatctcaggagaccgaaaaccgatcgctgaagaaatcgccgatcgagttgggattgataaggtctacgccgagcggctgccggaagaaaaaatttccgtcattgaaaaggtcgaaaagaagttccgcccagtcgtgatggtcggcgatggtgtcaacgatgccccatcattggcaatggctgacgtcggcattgccatgggagctcacggggcaaccgctgccagtgaatccgcggatgccgtcgtcctcaaagacgatttgagcttggtcagtaaagcggtcaaaatctcagacgacaccatgaacgttgctcgtcaatccgttttgattggaatcgctatctgtacgattttgatgttaatcgccagttttggcgtcatccctgcgatcattggcgccctcttccaggaagtcgtcgatactgtgaccatcctgtgggcattaagagcccgggcaggtgacaaacgggaaagcaatctggtaccagtacaataactaaatgatttttgttggccaatcgaagctcaaaccagttcaaccagtgaggatgacttgacaaattcggtcagtgctttatatttgtaatgataacaattaccattcgtgaggaggtaagataatgagaattcatgttgtaatgcataacaaagaaactggtgaagaatacctaaccaccaagaaccgtcgtaacaacccagatcggttaaagttaatgaagtattcaccaaagctgcgtaagcgcgttttgtttgaagaaaagaagagctagtttttaaagctgaaaggcggccacagtacaagttgaaagacttgtgctgcggccgcctttttgatgtggcgtttaataagaattccactccaagctgtcaggctcttggagtggaactttttgactatacaactgtattaatttgagtctgaacgatttccaatccctctaaaaagctggtttggccgctcaagcgctgtttaagttcatccacccatttttgaaccgtggtggcatcgtggctaatttccaagaagttgcttaaatccttctcaagctgctttggcgcattggcggctgtcttctgcgactgaggaatcaggacaacgtcatgatacagtggaatcattttatttttaaccgccggataaatctgtcgcagataattccggatcattggtgcgctttgatacttcttcagttgttcaaacaactttgaatattcccgttccaaagctaaaatatcaccatattcatagcgcgacagttttgtttccagttgtttcaacaaatcagggtaaaccctctgccactcatgacgctcgactaacagctgcttatattgttggtagacggcggtttgatggtttaacaaccgcttcctcaacagcgcaattaattcgtcggtctcacccaattcctgatacatattggacaacaattcgtcccattcttttcttagatatcggggaacgtcaagtgccaattctttggcttcatcataacgatggcggcttttcaagacaaaaaaccattgtttgcggacatcgtcatcgtccatatttgcgatggctatctcttgggcgacccccaaatctcccagtgccaggtaaagatgtaaccgcaacatcaggtgatgtttcttgcgttgatcttcatcccacaaagtactttgcttcataattctttcagaggccttaatgactttattggcagtctgctgagtgaccaaaccgagaacgtcatcgataaactcatatcgaaaagcttccaaatctttgaacactggactgccgaacagtttcagcgcttggtccagatatttttcacgttcattcactggtaaatgactgccggattcattgatcaaatcgatgataacgcccaacacattgttaactgaatcctccagagtcatcggcgaaaggctatcctctgaaaagaccttcatttgattttggaccaccattagggcaactgggaagcctaatgcaaacgggactttgagttcaccggtatcgtcaatgacttcccctagcagatcagaaaagaagttgaccaaattgttcataccgttccagtcccaatcagactcacgggcaatctgaagctggttggaaataacgccgcgaacatggcgaatttcttcttcaatcgcttgcgggtcggtatccggattggttgatggtagtggatctgcctcgacagtatcatgatcaacttcaaagccggcgtcgatatctaaatcaacaggaatatcgttaaaaatcgccaaaattaatgcagccatgtcggggtcaagggatcccatttttagcagcacattttttaacttttcaggtttagcctgattgattgtttttaagagctcttgttgcgagttgtttgccatctcaaattcctttcgaatcaatttgtttcttgaattttaccatatgtgggcttgaagacaaacaaaatcgggtacggaaagtaagctgttagcttccaatacactattgttttgacttctcatactccataaattgatacagcagcaattccataatcacaattaacgaaacgtgcgacgtcatatcaactccgctgactttgagttcgtccgtgaacagatagaggttttcgtcactcatgttttgaatcgtattgttattcgcgccggtaattgaaaccagcaaggcgtattccttttggctttgcagattttgaataatttgaatcagttcatcatcctcaccttcataatcaaaaacaaagacaacgtcgttgagctgtacgttgcggtaggccagccggcgctgctcgtgattctttgggaaaattacaatgaacccgttcaaagtatataagtattcaatgtattcggcagagtacttactgaagcccttggcaaaaaagtacagcttgggctgatggtccaacacctgacagatttttaacagtttgcgctcgtcaagcacccggacagtttcttcaatatttttcagatattcgttacgatatttggactgttcttcaacaaacggttcagccttgtcttcctgcttatcgctgttcaggaccgtgtacttaatcacggtgctaaattcactataaccggagaagccgatttttctgacaaaacgcaaaaaagtggtggtcgaaacataacaggccgccgcaatttctcggatactcttgttttggattttatccatattcttgatcacatagtcgagtaagccgtattcatttttattcaatttttcgacatatggtttaatgatctcaaaaaagttcatataaaacctctaatctggaaccccgaggacgatcgagtggatgtcgccgccgccaagcagcagttcacgggcgtacacgggttcaatttttcgatctggaaagattttggtgtattggtcgatggccgcctggtcgtgctcatcgccaaaaatgggcagaatcacggcgccgttcaccaagtaacagttaatgtaagtggccatcaaacgatcaccttcgtaacgcggcagccgaccgttgaccgggtcaacgccttcactctcggctttggtgattaataatggtttgggcatctggacccggtgaatcttgaaatgcctgccggacgcatcggtcgccgcctctagagttgccaaggcttcatggcagatttcatacattggatcagtctgatcttcggtccaggttaaggccacttcaccagggcggacaaagttgaccatgttgtccacatcgccattggtttcgtccatgaaatagccccgggccaaccaaataatcttggtgacgttcaaatagcgtttaaaaaccgcttcaacatctgcctgattaacttggccgttgcgcccctcggataagaccgattcttcagtggcaatcagcgttccttcgccatcggtctggtacgcggatccttccaagacaaaatcggcttcatagtagtcgatccggtccaagtcactgactttcccggataccaggttgtcctgatcccacgggaagtaaaggccgtcgaccaggccgccccaggcattgaactgccaactgacggctcggacgttattttgggcgttgaccaagtaagttgggccgacatcccgcatccaagcatcgttgtaactcatttccaccacccgaaccgattccggcaaggcatgcagggcgtgctcgtattgttgacgcgaaaccagcattgtcagcggctcataccgactaatcttcgcagcgacttcactgaaaactttttgagcgggtttggctccatcccgccagttatccgtgcgttccggccacatcatgtaggcctgctggtgttgatgccattcaggggccacattgtatttatcctcttgtggagttgtctttttgatcttcattatttacctcgatattttctcgctcaatcataacatttttgctgtgaaagcactatcattctgctaataccccatcaatcgacgcaaaacgaggcatcaacaaaaccgtcgtttcgtccatgcctcgttcattttaaactatttaactgctgcgggaacagcatccttaacgatagttgtaccttcgttgccttcgatgatttgttcaacatcttccaaatcaccgatcacagcgggattgccggtactgcggacaaaggcgactgctgcttgaacctttggcatcatactgcccttggcgaattcattggcatcaatgtgtttttgaatgtcgtcaatgccgacttctttgagctcaacttgatcaggcttgccgtaattgtagtaaacccctccggcagacgtcaggatgatcaatttgtcagcatcaattaattgggcgatctttgaagcactgaaatctttgtcgatcacggcttccttcccaattaagcggttgccttttttgacaacgggaatgccgccgccaccggaaacgattggcacgatacctgcgtcaacgaccttcttgatcgctgcgtactcgttaatttccaacggtttcggtgatggaaccacccgtcggtagccgcgaccggaatcttcaatgatttcccagtcagggtgcagtgacttgatctcaggcaaatccgtttccttatagaaaggaccaatcggcttggaaggattttcaaaggctggatcgtcctcatcaacgatcgtctgggtgacaattgccatcacatctttatcgatgccgttattcaggagctcttccttcatggcattttggaaccagtagccaatgccgccctgggtcatggcaccacaggtatccagcggcattgccggattgacttcactgtcggcggcattttgctgaagcaataagttgccgacttggggaccatttccgtgagtgatgatcaactgatcaccgttcttgataaatttaaccaactctttggcagtctttttaactgccttcatttgcgcttgagcggaagcatcctttgagaggatggcatttccacctaatgcgacgacaattttggccattgcgattcctcctatctgccagctggcacttgttgagtgatgcagtgaatgttaccgccaccaagtaagatttctcgggcaggaacaccaacaatcttgcggtctgggtacaagcgctgcagagtttcttgtgctttagcatcgtttggatcgtcaaaggttgggaagacaattccgccattggctgtgtaatagttgacataactggcagccaagcggtcgccttcacgacgtggcaaactgccgtcaacggcatcaacgccttcgctttcttctttggtaattgttaccggctttggcacataaagcttttcaacttgaatcttgcggcctttggcatcagttgcgttgcttaaaatgtcgtagttttctttggaaatctcgtattgcggatcgttttggtcatccgtccaggcaagggcaacgacaccaggtttaacgaagttggcaatgttgtccacgtgaccattggtttcatccaggtagatcccacgtttgagccaaatgactttgtccaaattgagatattccttcaagacattttcaatttgttctttggataactgagagttgcgtccctttgaaagcaggcattcttcagtagtgatcagtgttccctcaccatccacatgaattgagccgccttccaaaatgaagtcgtctaaacggtaacggtcggcgtgctccatttcagtcactttttgtgcaacccggtcgtctttgtcccatgggaagtacaaaccgtcaaccaagccgccccaagcgttaaatgtccagtcaacaccgcgaaggtcgccatcgtcattgacgacaaacgttgggccgcagtctcggatccaggaatcgtcactggaaatttcaaccacttcaacctcgtctggcagcatgtggcgggcattggcgtattgggcatctgataccccaaccgttacgtgctcgaactgggaaatcgctttagccacgttcacaaaggtatgctgagctggcttggcaccattgcgccagttatccggccgctctggccaaagaatgtagacacccttatgatgttcaaactcgccgggcattctgtatccatcttttttaggtgatgattgtaaagttttcatcgtatttgctcctcttgcattagattcagaaattagtttttacttaaggcttcttctgtgtggtgactgctcgccttgacttttttcttcaacggatgattcttttcagcggctctgatgcagacctcaccaagtaagattgtaataatcgttccaattaaaattggaatcttggtgttaagctcttcggcactgccgttgagtgggaatgctgacagaattgtcgtgatggcaagcaatgccaccggaatccaagtcatcaagttaatcatcaaatgattgccgggaactttgaatggccgctcagtatcaggatcaattttgcggagtttccagaatgatggaaacatcagtaggtatgagcccaacaaggcaacgacattcagtgagaagaatgcccagaaaatgttttgattgggaatcagtggtgaaatgaccaccagaacggccgcaatcccaccgttcaacagattggcaccggttggcatcccggtcttcttgctttcaataccaaatacctttggcaagtcgtggttcttggcagcgtatgaggcaacgtagttcaccccggcagaccaggaaatcaggttggccgctaacgtatacataaacagtaacgcaatcaggatgacgaaccaattattcccaccgatcaaaagtaggatactttccatcaaaccactggaagttgacagttcgctgcttggaattgccacgcccatgccaaatgcggcaaagacatagaagacagcgattaagataccgccccagataatggcctggggaatttgtttctttggattaggcatttcactggccatggaagtaaccacttcaaagccaaggaagttaaataggatcactgagatgtagccaagacttttaacgtccatctgcggcaacatcgtcttaacggtgaagttgctggcaacgcctttggtcatggcaacgtaaatgcccaaagcacccaggctgaccatgataatcactttggcaatcgcagccagattcaaaatccatttactgtcggcaactggatatgaggaaatcaaagtgacaatcccgatgaagaccagctggattaagacgttggtccacgtcccgaaatgagtcgggaagacttggccaatcacaccggtaaacagaacggccaggctggccatccaaattgggaagttgatccagtacagccaagctgcccgaccaccccaacggcggccaaaggcttttctcacccagtcataaatcccgccgtcttcgtcataggtcgtccctagttcggcagaaatcaacccgtatggcaggaagaagaataccaacaggattccccaccagaagaattgcgacgggccgattgcggcagccggagcaactgattcaaccaccaggacaacgaccaccgacatcagcacggcatcaaatagtctaaattttttctctttttgcatttctttcacctgcacatccgttgcgtcagctcattaatgagtcgtgtcgtcaactaagtttaagatcatcgacttcaatttaggatcgttcaaatcatccaattgtttttcggtgtagttcatccgtggtgccatcaagtaaaccagcaaagcgcgcattgcagtcaaacggttttcggcttcatcccaggcaattgagtgtggtgagtcgatcacgctgtcagtaacttcttcgccgcggttggctggtaagcaatgcatgaacattgtgtggctggtgcctttagccattaaatcgtcattaacttggtacttaggataaaagatcttcattctttcatcgtatgaaagtggggcttcgtacaggccataccaaacatcggtgtagacaaagtcggcatctttcatcgctgcgtcggcatcttcggtgatttcaacactaccacctgatacttcagcattcttcttgccgatttccaaggtttccggcttgatttgataaccctttggtccgaattgaacgaacttcatgcccatcttagaagcgatgaacattaatgatacacaaacctgagtggcgtcaccgacgaagacaaccttgcagtcgctgagtttcttacctgctggtaaatgctctgccatggtgatgatgtcgccaatttcttgagttggatggttgtaatcactcattccgttgagaactggaaccgtggcagtttcagccaatttttcaactgttgagtgcttagcaactctggccatcaggatatcaaccaagcgggaaagaacaatggcagtatcgcctagtgattcactttcagctgaacctaaatgaatttgacctggtgcgaggtactgagcgtgaccgccaagttgagtcattgcagtttcaaatgatactcgggttcgtgtggatgattcttcaaaaatcattcccagtgtccgatgtgataataagtcgggatagtttccattcttaatgtcgcgtttaatttgtaaacctaagttgatcaggtattggatttcttctcgggtgtatgtgttggtatcgataaagtctcgtttcataattggcatctcctataattttgtttgtcgtttggatctcagaaattctcgaggatttctttacgctcttaatataacggatgtaagcgctaaaatatatagtttgaggccttctagacgccgtcagaacaacgatggagtttgttccacctttgttaacatgttacacgaggctgatgtaaaccggtttaactcacttttaagccaaaacaagcccgcaacctgagtaaaatgatttactcatgattgcgggcttgttaacgtttcattttataacaactgtttcagcttgaatcgctgcaccttaccgctgacattggtgggaagtttgtcaattctaataaatctcgttggtaccttgtagtgggctaacttctgtctgccataagtgatcaggtctacctgatctaagggcgcatcgctgaccacaaacgcaacgggcacttgaccccatttggcatcatcttggccaaccacggcaatctcgccgatgtctgaccgattgacataaacggcttcaacctcatccggaaagatattttcgccaccagaaataatcatatcatccagtctgccatcaatgtataaaaagccatcatcatcaaaatgaccaacatcaccggttcgataccagccggtgtcatttagcttatcttgaaaagcagcctgtcggttcaagtaacccggagtcaatgccggcgttttgatcagcacttcctgattaacttgacttaacgttaactgagtcagaaacagtggcttgccaaccgagccaattcgcttgtcagcatccgctgagttcaaggcaatgatttgtgaacaggtttccgtcatcccatatgactgaaccaccgggacttggagttgacgacattgctgaagggtttggcgatcaattggcccaccgcccagcagcatgcgctgaaaattggcctgataaggtgtgttatcagccgttcgatattttaataattgctttaacatgtacgggacaaccgaaatcgtcgaaatgggttcatgtttcaatacgtagtcaatcaattcagcattgaagtggccgaccaagcggactgccattccatatatcaagccacgcatcataatcgaaaaaccactgatatgaaaaattgggacggagcaaagccactcgtcacccggcatgaccccaaggttaaaagctgaggcggttgctgaggcgaggtgattgccaaaggtctgcatcacacctttgggtctaccagtcgtcccagacgtatacataatgctggccacctcttgagagcgaaattcgggaactaatgtgatctgaaccgccgcttgatcagttatcgtgctaaaggtaataaaccgttggtcaaaactttctcgaaaaagatcatccgccaccagacaggccgctggttcactatctgataattggcgatggatttcatcatcagacaaacgccaattaatccaaacgattgtcttaccggatcctaagaccgccatggccatcagatagcctagtaaagaattcttggtcataatcccaactcgatcgccatccaacacggaggcagccttcaattgtccagccagttgagaaacctgctgcttgagttccagaaacgttagctgggtgttgccgtcatcgaccgcgagccgaccaggggcagtttccgcctgctttaaaatccaattatccactttcatcaaccttcctatgggaacttaggaaattgatcaaaatcaggctgtcgtttttgattaaaggcgtcccggccctctttgccctcatcagtggtgtaaaagagcatcgtggcatccccacccaactgctgaaggccagccaaaccatcggtatcagcattcatggctgccttgatgaatcgaagcgcggttggcgatttctggagaatttcgttacaccaatccaatgtggccgactcaacctctgaaagtgggaccactttattgatccagttcatttcataagcctcttgtgcactgtagaaatggtttaagaaccagacttctttggctcgtttatggccaatcacccgggccaaataaccggatccgtagccagcatcaaagctgccgactttcgggcctgtctgcccaaattgagcgttgtcagctgcaatcgtcaaatcacataccagctgaagaatgttgccgccgccaactgaccaacctttaaccatggcaatcacgggtttggggatgattcgaattaaatgctgaagatccagcacatttagccgggcaatgtggtctgaaccaacatagccgccattcccccgaaccccctgatcaccgccagaagaaaaggctttgtcgccagcgccggttaggataatcacgccgattgtgctatcatcacgacagatattgaatgcatcaatcatctcttggatggtcagtggtgtaaaagcattcattttttccggccggttcatcgtaatctttgcgattttatcggcccgttcaaaaataatttcctggtaatcttttaccgattcccatttaactgaagtcataatctcgatcctttcaaaattggagtgtgaatactttgtctaacttaattgaattgcttggtatcaaaactgtctctgtcagccaagctgaggttattatatcactagaagttaccgattcggtcaaacagccatacggcattcttcacggcggcatcaactcggtgttggccgaaacggcggcttcaatcggtgccaacgaacgattggataacagccattacgcagtgggcgtcgacatcaccactcagcatttgctgccggtttttgatggcaagctggtggcaaccgccaccccgttgcatgccggcgggcacttgcaaacgtggcgagttgcgattcataatggcaatcgactcactagttttagtacggttactttgaccaacgtcgctcaaaagtcttaacttctttggtaactaccatgctattttgttgtcaattgttctcctaccaaaaggtcattggacaaacccggtagttggcaatcaccaaatataaaaaagtgaacccaggcaggggttcacttttttatgattatttgcttttactgtagcgtcctttttgccacattttccggctggtagtcaacgaaaatgatagctataaagcaggaattatttgagctataacatatagtttaccgatcggtgacatgtcccttgtccttaagactaatcttcccatccaaaatctcataagtcttatccgcaaaatccagcagccgaagatcatgggtgaccacgaccaccgccttattcctggtttctgcgagatttttgaacagttggccgacctcggcaaccttttcactatcaagggcagctgttggttcatcggccaacacaatatccggattggcatacagtgctctggcaatcgccactctttgagtttggccgccagatagttcgccggggaactggttgaccagctgagaaatgcccagctgatcaagcaaatccgctaattctttctgatctaaattaccgtcatgcttgattttatccacaaactcaaattgttctttgactttcaagtacggcaccagattatatgattgaaggacaaagccgatttgatttaaccgcagctgatctcgttgcgcttttgtgagtgactcaactgcttgaccttcaacttccactgaaccggaggatggcgtctgcaggccacccgcaatggtcaagaaggtacttttccctgatccagagggaccaaccactaggatcaactgtccccgatcagccgcaaaattgacatccttcaaaacgtgaaccttgctaataccggatccaaagtacttattaatgttttttaattcaatcactgacataactaacctccaataacactgacagggtcaacggttgcgatcttttgcgctggaattgccgcaccaatgacgcccataatcatcaagccaatggaaatccaggtgagcaccggaatatcaaaggccatcggcacaccgaccggaattaacgatcccgtcagaaccgccaagagaccaccaatgataattcccgaagccatcaagatcaaagattggctggtaatcgtcgtcaccaaagctctcgctggaattccctgggcccgcaatactgcgtaggttggcagagcctgcatggtcaaaatgtacaggaacacggcaatgatcaccaatgaaataatcatcaaaaagccgatcatgaagccaaacgtggtgttttgcgcagaataaccgggcaacttattaatgaattcattcatcgaatacgtctttaactggctattgtgagcactgtacttagcattctttgacacaatcgcactgccggcaatcggaacccggtccatcccccgcaaatgtttccacgttggcagactaccataaatcactggagcaatgtttaacttagcgttcttagtgaacccgacaatttcatatttgtcactcacagagttcaacgtcaccttgtcaccgagtttgtagccatcggtcttgaacttttcgtcaaccaccacttgatggttgttgcgagctttatgacccgaagagatttttaatcccttatagatgaactcactcttcttgatgccgacaaattgggcagaaatcttttcttgacctttgtgtttggcaaccaccggcgtcgacccaatcactgattccttagccgacagtttgtcgtccttggcttgggcattggtaatcgtcgactgagacagattaatattggaatccttattcaagaccacgctcttggcatcccaggaattgatcgcctgggtgttttccccagccaatccgaatgccaaacccgtcaggataaaaattaagtatgcaatcaaggccaccatggcaataattaggccatacctcaacttttcgtgtcgaatttcttttagtgccaaatacattatgcattccccttcccggctaacaagttcaatgtttcagaaaactttttcatgactactgattcattttgcggctcaatcatgatttgcttaatggcctcatgactgaggatcatcgtcgcccattcccgcgaactaaccgtgttggggtcaattgatccttgcgaaatcagtgattcatttttcattaggtgcatcttgatcaatcccagatactgactatcgcgagcacctttgatgaacgcctcgacttgatccaaataaaactgcgggtcaaattcagttcccacctcgttgttcacatcactgtgaatatcgcgcatcgccacgccgtataaatatttgtaagcgtcggttagatcatcaaaatacttataaaaggccccccgggcaatcccggcagtcttgacgatcggggcaacttgagcggttgccagtggttgatctgtaaattccttgagtaaggcttttcgaattttggtctgcttctcatcacttagattggtaaaggttgttgataccataattgttctcctttgcgtatgacaccgtgtcatcaatttatgaactgagtataccccatcggtgacaccgtgtcaacataaagtctcaaaaaatccgtcaccaaggcagcagccttgatctgacggattttaatggtattaatatctggttgttgaacgtaatagttctggattacggttcgacagcagcatggcgtgcccggttgagtcaaaaatcatactttcaaactcacggtgagaattaaaacgagtgtatttaatgtcacttggacgcaaactgccactgccgtttaatttacgagccggcagggtttgaattgagtcatcggaaaccaggtacagtcggccgttgtgcgggttataccccatagactgctggtgagttccggtctgctttctcaacagctgcttggctaaacgaacatggatcgagcggctgcccaacttgcctttgtaaattttaacgtggccgccggaaatcccccaccaataagcgttaccggagttgtcaaacgttaggtcatggccggccggcaccattgcaccacggttgttcatgtgaaacttaatggcacgatttggcttcagcgacgacatgctgattcgttgaatggttgaccaggcagtcggcttcatgtcagcccgatcccgccacatccaaattgaatgctgcttcttattgtaagccagcgattgaccgtgaccgacatcaaacattggaccaactttcataccggcagtctttttaagcagagaatcttgagccttggccaaactcatatgatccagggtactgcggttatatctgaccacaaagcccttcccatgaaattggtgcggcgcatacagcacgaacagatatttcccgccaaatgcggcagcttgaggattggtcaaatcacgactggatttccccaatgccatatgcgtacttgggaggagatatttggtcttcagcgtccacttcgtaccatggacactcttgatggtctcactaccgctgggattctttgaccagccatagttgccattggctttgacaaactggactttactgttattcaaaatgcgtaaactggcgcctgaatattggctgatggcgttgcttttttgcacatacgtcgccgcatcaacagtacccacaaatgacgtactcaatagaatcgctgtggcgatccccaccgataactttcccaatttcatacatacccctccagatatttggttatattgatataacatgccccgcaacttcgcctgcggggtggctaacttgttcttgcaatttccgcaatcttttttttgtttttggtttcaaatttgattttttatgtgcctgtattaagtgaacaggagttaatcctgtgtgctctttgaaaacttgatactaactgctaaagacataaatctttaagcgagcccgattagtttagcgcgatgaccagcaatgtgagcgatgactgaacttaatcaaggtagatttaccacctactgcgttaaccttaaagatggataatgatacttctgcgaagctcccacgtaacgaggagaggtgcgattcctatgtgcttgttggtcatgagcctttagcggtttgttgtttctgattctgatataatgaacttgcaaagtctcactttcaagttcatgcaactatgaaaggaggtcttgctgtgccgttactagttactgtcacgaaaagcgatttagtcgcgttaggttatggcccgtcacgttcaactgatatcatcaaactggctaaggccgtaatggttaacaaagggtttgaatactatcgtgctagaaagctcggccgggtaccagcatcagcagttgaagaaattttaggcattcccattagtgagctgattgttcccacaagcggtatctctacggttaaggaggaactatcttgaccactaaagatatctttaaaaaacaaaaaaacggaacgtatgcattcagagctaatatcggatttgattctaaaactggtaaacgtgttcaacgacgtggcagtggctaccgtactaaaaccgaagccaaagaagcctatcgtaaaatgatggccgatggccccgataagtcagcagagttatcccaaatgacttttgagcgttttgtaaatgatatttttaaaccgtggtacaaaacacaagttagaccacaaacttataaacatcgctcaggaatcataaacaagcaactatcttatttctcaaattatctagttgaccaaatcaaaccgttagatattcaaaagtggcagattattctgttgaaaggccattctccatcgtctgcacgggccattaatctaatgctagcaaatgttttagaacgagcgaaaaccttaggaattgtggaaactaaccaggctcgagtaattgggtacatcaaaaagcaacaatccgaaattgatttttggaccaaggaagagtttcaaaaagtgattgaccataccgataaagccggtacctatacccaacattttgaatttatggtgttgtggttcttatttatgactggtttaagaagcggtgaatcacgggccttgttatgggacgatatcgactttgtccatgggacagttgatatcaataaaacattaattttttacaatgccaatgactactacttctccacgccaaaaacgcaagcaggtaaacgggtaattgttttagatgcacaaactaaggaatttttacttgaatggtacgaagaccaaaaattaatgacgagttctaagtttgtattttcgcttgatggtgtaccaacgccaacaatgacctatacacggattgttactgcttactccgaaattgcgggtgtccatcgaattaccgttcatgcgctacggcattcgcacgcatcagtgttaattgacatgggagaaaatccattagcaatcaaggaacgtttaggccacgcggacataaaaacgacactcggaatttatggtcatctgtaccccaaaagtaatcttgaagttgccagccgattaaatggtcaaattaaggcgccacagtgacaaaaaacttaaaaacgccagaatgtgccattttggtgccacttggcatatctaacgcttcaaaacattgatattaaagagtttcaacgcagttgttatgtttcacgtggaacaacacacaaaaagatggtctgaaaaagatcatcttttttaataacaaacttttaacgattgtatcaatcactgattccttgcggtagctgcggttgagaagagtttttaggctgattcagtaatttttgtctgctcaaggttaagactactgaagtggtgaagatgattaataaaataccagtaatggcaaagattggcaaagctgacagatgatcaaataagaaaccaaatacaattgtcccaagtggcattaataacatactgatcgtgctaattagtgagaaaatccgtccttgcatgtgctgcgggattaattgttgcatatacatgcccaaaggcgtgttaatgaagaccaatattataccgtttaaagtatttaaggcaataaagtaaatggtatttatatcggcagataagtttagaatttctggaattcctacagcaatgaagacgagtgataaaaagccgatgtttaaatatgaaattagaactggatggtgttttaatttcattaggctcaataaaattcctccaagaaacatcccaacggccagggatgaatctgtgatcccatactgggtgctggacaatttcaacgttttaaccaggaaatagggttcgccaacgttgacagcagagaagaaaaaattaatggctgccgaagaaatgattaaaatacgcattaaacgttggttacgtaaatattgaaaaccagcacgaaaattctgccagactgtttctgtagagcttgcatctgttgattgaggtttttgctcttgaattgcattcttaaaacgaagaaacatgattgtgaataaagcaattagttcaaatccaatttcaataaatgcaaaattgtctatagaaatcaatgtatagacgagagcaccaataattggtgccaagaaagaagctaacgacgaaacagattggtttaacgaatttactttctgtagttcatccgagtcaaataattgaacaaggcttgcagtgagcgttgtactgagagaattatcggtaatttgaaggataacaattaggccgataagttccgcaaaatattgggctggccatagctgaaaagtaaaaccaaataaaagtaatccaagactagttgtgatttgagcggcaatcataactttacgatggttgaaagtatccaccacaaagccaacgaaaggagtcaaaagtagagaaataattggtcccgtaattaatgacacacccatacctaacgcagaaccggttcgatgaagaatatataaaccggtggcaaaagacagcatgccactgccaaacccaccagtgaacttaattatcaataacctaatggtttgtgcagataatttaattttattcataatagcatccccaattttgaagtaaaattgtccttcaattattgattaatagtttctaacgctaaacataatgaactgtaatgtcgccgatattaaagttcccggtaatcgtgactaaaggtccagtttttgtgggcttttctcctgtttcagcaacttcagtgataaatgaacttaatttaatttgtgtgtgccattctttgggcacatacaggtaaatctcacccatgcttccgttgaggctgatattggcttgatcagcaacgatacttgcttgatcaaaataaattttagcgtcccccatcgtcacattaattgttgcctgctgaaaattagcagattggacgtaacgaatagcactccccatgcgtacattgacatcgacgtaggattcatagtccgttgttgtactttctgaataacgctgaccattgctatcgatcgttttattgacaataatgtgttgatggggatgaacttttcgttttaaaggctgtaacacgagtgataatccaatacttaggagtaaagcagcacccagaattgtccagggaactaaattggtgatgccaaggggtttcgcataaagaatactgataaaagccaggctgaagacagtgccgcttacgctaaagtaagccatgctcttgatagtagcagccaccaaaattaaagttagaaaaagtgtccacatcccgatatgataagtaagccaacctgctttactagcgattaagacaaaagcacaagctaagaaaaatactccccagaaccaatgaccccattttatttttgtattcataattattacctcatttcatttaatcgttcttgtagttgtttgtagtaacggcgcgatgcgtaaatttgtttatgcgaattgcgaaatgaaatcagacaatttgaaatggatttcgacaatgcattgacttggtacagattaattaaagctgatttcaaaacttggagaaaataaccaggaagtgtatcagctaattcgtagagatgctttgtactcgtgtaaatattgtctgctgtatgtatttgtaatcgccggtctgcagtttcaataaaaaggatactatccaacttcagaaaatattcggttttatcttgatagcacttgatggtgtccgcagtggttgatttttccaacaagtttttgagatgttgaacggtcgcatcatctttaggtgttttaataacaacttctggctcttgtaacgagctatcaatttctagtcgcactttcattcgcattgcccccttcctgttgccttgatattattagactacttttaaatgaggaatggaatactttttgtttaagtggcacaaaattacgcgtaaccggttaaatggtgaacagctgagaatctagttaaaaagttgaaataggtatcaaagaacataccatattagtggtaaactattgctagtttattagagtattgaggatgaaaaattatgaagcaaaaatcacaatggatattactactggcaacttcaatggtgtcatttatgtcaacaattgatgccagtattgttaatattgcggtgccacaactttcccacgaccttcatgttcctatgaatgaagctgaatgggtagtgtccgtttacttagtgttaatctgtatgttactaatattttttggaaaattgtcggatcaaattggccgtattaaactttttcagattggcactttaatttttgtcattggctcactaggctgtggcttaagtatgaatttgccgcttatgctgggagctcgggtagttcaggcaattggagcttctatgactatggcgacaaacttcggaattattacgcaaatttttccacgcaatcgtcatggggtggcattaggtgttaatagttcatttgttcaggtgggaaatattatgggtccgggactaggcggactaattctttctgttctttcctggcattttatctttttcattaacgtgccaattggtttgattgcttttgtgtttggatacaaaatttttcctaaagagcctgcaatccatgagaaagtaaaaattgattttcccggctatttggcctatgtgctcgcaatagttagttttttcgtggccatttattggggtcaagaagttgggtttgccaaactgaaaatcctgggattattctgcttaagtgccatttttattgccatctttatttttcacgaaaaccgagtcggcaacccacttttaaatttacaaattttcaaaaatgtgggattttcaatcggtgttatttcaacaatgctagtatttgcggttggttattttaataatatgatcatgccttactatttgcaggaaactctgaaatattcgtctgcagtcgctgggctaatcttgatggccgtcccacttttgaatattttttcagcaccggttggtggcatgattggtgatcgaattggtgcggacgaggtttccttaatcgcacttgtgatctttttaattcctgaactgatttttatgttcattacgcctaattgggggattgtttggctggttattgggctaatgttgtttggtttggcgaatggggcgttccaaaataatccaatgataatgggaaatgctggcaaacagtttcaaggaattgcgggatcgattgcggcgttggcacgcaacttagggatgtcaattggtctgtcgttgtcgacatctctgttatattttggtattagtcaaaaagcgggtcggcatattaccacgtacccagaacataatccaaactggtttgtttatggtatgcattttagttattggtttgcgtttgctctgatcggaattgcactggttttattgattactttagttaagcatcagaagaaggcagtctaaaaaagcgagattaagcaaaaggatttttctgcttaatctcgttatattttccggatattatttctaaaaagtgaaaagaagcaagttctgctcagaatctaactgcttttccccttttttatgtttaattacctagttattagttaaaaatttagttaattgaacttcaaaaattggtgtccaaacttgcttgtaacccatttgggtagggtgggcatcgtcagccataaaatagggactagttttaatcaaattatggaggacaggatctgcccagagatcgatgatggcgaaatgccactttttctgtagttggtataactgactgatcaaacttgcataatcttgatctggcttacgcatgcaagtgtagaaaacaacaggacagcgaaaatgggcttgaacgtaagctaaaatatcttccatggcgccaagggttgtctcacgatcaaaaccgtcagtttgcacatctggagtaatttggcctaggtctttattagcccggctatcatttgtagagagctgacaaacaaagagatcataattagcttgatcatcaaaatcggttcgaaggcgacttgaatacgtctttggttcgagtcctgctaaagtggtgccactgatggctgatttagtaggaataataccgtcttttgtttgcaagtactctacaaaagacttgccttttgcagctgcgccataggtaattgacgaacctaaaaaggcaatacgtttaccatataatttggaactggggttcaaaacttctgttgaaggaagataagcaggcaaattgcccaacatgattgcttttaacggacggggaattttgtgaatcccaacggcagtcgctgccaatataccagtatttaataggaattttttcatgtgaatcacctcagaattattgtagcacggaataaaaagctgagatgagttttatgaggaaataagggatgaaaatgaacccttgtaaagttgtcaatttggattttgactatcaaattatgaagaatttatatcagtttaaactttgaacgagatttttggcagagtttgcactaaaatagaaaataaataagttaattgaggagtttccatgaaaactataaaaagtattctaagttgggtagtaccgattctaattgggttagcaattgctttattagttcgtagctatctgtttgaaattgtacgggttgatggcacgtcaatggaacccaatctggttaataatgaacgcgtttttgttttaaaacaagaaaagattaaacatctgagtgtcattgtttttgatgcctatggtgctgatccccaagccactccagggacggagtatgtgaagcgagttattgggatgccaggtgataagatttcatataaaaatggcaatttgtacgtaaataacaagttagtacctcagaaattcatcagtgcgcacgaacgaacgacaggaacagaaattggagcagaagcgacagattggaacttagcttctgtggcgaaagcccgtggctgggggaataagcccgaaaaggtgccagctggtgagtactttgtgttaggtgatcaccgaactgtgtctaacgatagtcgttattggggttttgtgaagaagagtgaggttatgggagtcgttaaggtcccattctggggtagtaccgctgctaaaaagaacgtcaatgaccgaacgagtgattattaatcaactaaacaaattagtgttgaaaacggataaattccgattcaacactttttttagaaaaaatttgctatttgcggagtctgcactaaaatagaaaataataagttaattgaggagtttccatgaaaattataaaaagtattttaagttggatagtgccgattctaattggtttagcaattgctttattagttcgtagctatctgtttgaaatcgtgcgggttgatggctcatcgatggaacccaatctggttaataatgaacgcgcttttgctttaaaacaagaaaagattaaacatctgagtgtcattgtttttgatgcctatggtgcggatccccaggccactccagggacggattatgtaaagcgagttattgggatgccaggcgataagatttcatataaaaatggcaatttgtacgtaaacaacaagttagtgccccagaaattcatcagtgcaaacgagcgaacgacaggaacagaaattggagcagaagcgaaagattggaacttggcttctgtggcgaaagcccgtggctggggaaataagcctgagaaagtgccagctggcgagtactttgtgttaggtgatcaccgaaccgtttcttacgatagtcgttattgggggtttgtgaagaaaagcgaggttgtgggagttgttaaggttccattctggggtagcaccgctgctaaaaagaatgtcaatgatcgaacgagtgattattagttaattaacaaattagtgttgaaaagggataaattccgattcaacactttttttaggaaaaatttgctatttatggtaaaagtattaaaatatgattagtttattcttaattttatgtttaattttggaggtgccacatgggaaaagaagtttcacaagaaaacgttgctaagtttcgaaaagtttttaatgaggataaccgcaatgctgttgtccaacgggcagctacaaaaaacggtgttttaaatgccagtgaagatattgccgctaaagtacgcttagatcacactttctccgttgaaattgatactggtaaagtttccaaccagctacatagtggtcgttgttggttatttgcgttattgaatacccttcggcatcaagttgctgataaatataacgtcaaagattttgaattatctcaagcttattcttatttctgggataagattgaacgagccaacattttttacgaaaatattattcgcactgctgacaaaccagcgaatgatcgtgaagttgaattttacttagaaggacctggtggtgacggcggtcagtgggcaatggcggccggattagttcaaaagtacggggttgttccttcatctgtgatgcctgaaacttttaatacaaatgatacgaccggtttcgggggtgctttaaataacaagttacgtaaagatgctattgaattacgggaattaacaaatagtggtgcttctgaaggtcaattgaacgccaaacgagatcaattgttgggtgaagtttatcgcatgacagccatcgcagttggcgaaccacctgtaaagtttgattttgaatatcgtgatgacaaaaagaattatcaccgagaagccaacgtcacaccaaaagaattctttgataaatacgttgacgttgatttggacgattatgtggttgttagcaactcacctgataaaccatttaataagttatatagtttaccagctgaagataatatcgtgggtggaaaacccattacgcttttaaatgtcgaaatggatgtcatacgaaaagcggccgttgctcaacttaaggatggcgagaccgtctggtttggcaatgatgttttggaacagatggatcgcaaagacggtttattagatagtaaactttatcaaaccgacgcgctgttcgacgttgatttaagcatgagtaaggcagaacgtttgcagtacggacaagcagctgtttcacatgccatgacgattactggtgtcgatgtggtcgatgatgacgtcacaaagtggaaagtcgaaaatagttggggcgaaaagaacggcgataagggatactttgccatgaccgatgactggtttgagaactatgtctatcaagttgtggtccatcgcaaatatttaacggctgatcagttaaagatcgctgattcgaaaccagagccgttaccagtttgggatccaatgatgtaattaaaagaaattcgcgaagaccggtgtaaaaagcctggtctttttattttggcaaaataggaaatagtctaccgtgaaaagattaaattaaaataaaagaaaattgtttacatttattttcggaacgcttataatatcctcttgtatattaaactggacattgaaaggagataaacatgcaaaagcttgtgaaaaatcatgggattgcgctaattgtttggattggcataattttaattagtatttttagtttacctaatattgatcaattagtaagatctcatggtgataccaagatacctagtgctgcacaaagccaaattgcaaatcgaattcagtccaaatggggctatggacaagggaatacgacgcaagtagttgctatttttaataatggcaacaaaaaattaaccgcagatcaaaaagagaatatcaatagtaccattaattatctgcgcgataacaagaagaaattgggaattaaggatattacggctgcatcggataatgcggaaacccgtaaacaattaatttcaaaagacaagacaacagaacttgttcaagtgttggtttcaaaggatcatggttcttataaaaccattgatcgagaactaaccaaagccgttaaaacccctaatgtgaaatcttacattaccggtggtgacattctgaatgaaaagttctcggaagctacccaagaaggggttaagaaaactgagattattgcggcaattttcatttttattgtcttaattttagttttccgatcaccaatcgtcccattaatttccgtttttacagtgggtgtgtcgtttatcacaacgctttcgattgtgacgaacttagtttcacgagctaacttcccattctcaaactttacccaggtctttattgtggtggtcttattcggaattggaactgactataatattttgctgtatgatcaatttaaagagcagttaagtaagggtgaagatcggcatacggctagtaaaaaggccattcgaacggccgggcgcaccattttatacagtggttcttctgtatttattggtttcctagcacttggtttatctaagttttcgatctataaatcagcagtgggcgttgctttaggtgtcgctgttttaattgttgttttattaaccttaaacccatttttcatgcacgtattgggcaaaaagatgttttggccatctaagaaatttgatggtcattcacaaagcaagatgtggcatgctttagcgaattcttcaattttgcatccactaattgctttggcattagtgttacttttaactgtgccttttgtgataactggttcaggaactttaaattatgatgatttagatgaattgagtgatacattacctgaaaaggttggattcaatgtagttaaggataatttctcagcaggaactgctgaaccatccacactatatattcgctctaacagacgtttggataatgaaaaaactttgaagttagttgatcaaattaccaaacaacttcaaaaagaaaaaggcattaaaacggtcgcttctgctacccaacctggtggttctgagattggtaaattgtatgtgaagggccaagtcaaaacagttacaactgggattgataaagctcacacaggcttgaatacaattggtaaaggtctaactagtgcgtctgatcagttagccgcaaccaatatgagtagtggtttgaatagtgttcaaaaattaattgatggaactgaagttttgcgtaatggttccttgaagattacaagtggtgctaaccaactttcaagtggggcttccaaaatttcttctggagtttcgtcaatgggaacccaaatggaacctttagttagcggtttgaaccaatatgctggtggtgttgacactttaagttctggtctaagccaacttggtaataggtctggagacttaaccagtggttcacaaagcttgctgaattcagctcaaaaactgtcaactggagtttctacactgaatagtgcagcagtccagattgattcacaattggatacgctccagcaatcattaagtgctggaaatgcagcaatgagtgaattctctggtttgagtagcaaggtgaaagaattaaatgctttaaaggcagagttggctcaatcacaaaacgcaattaatagtcttgaacaattggcaccattattgactgagttggaatcggctaagaaaaacttagcttcagttaatagttcatttgctagtttagacaaagtttctactgcgttaacttcagctgcaacagattctgcacaagctgcggcttctaatacagacgctcttaaaacattgcatggtattgatcaaagtgatcaaagtacactgtcatctgctgacaagaaaaacttagctacagctgaatcacaaattacagcgggtgctaagacagcgggcgcttcagaacaaacgattaagaaaacattaagtgggctttcaagcgtcaagacacaggtcaagacacaggtcaagacacaggtcaaaagtcttaaaaaagaattggatgcagtcaatattgattccaacacactcactgagctgaaacagcttgaaacagtgatgaagaaagcaaatacattgatgaattcaacaaacattagtgaatcacagcttaaagagttgagttcattgggaacacaattacagagtgcttctggtagcatttcaaaactgaaacagtttacggctggtgttgagcaacttaacacgcaggtcaataagaattctgctttagttaacggtgtttctcagctgaatagtgggattaatacgtatgctagcaaggttcaacttgcttcaagtggtgcttccacattagcaagcaagagtagtgaactaactagcggagtaggaactcttactagtggtttaggcacgttaacaagtagccttaaccagctttcaagtggtgcaagtactttggcaagttcaacgcctgctatgacaagtggtcttgatcaggaagtttctggtcaaaagcaaatgtacagtactttgaaaggcttatccggaaaagtaactacgcttcaatccggtttgaagacagccgcaaaaggaactaaaacgattggttctgggatgacaactgcaaatagttacttaaacggtatggggaattctgcggtaggtaagaccttctatattcctgcaaagcaaattcatggcaagtcatttaaacccgttttgaagacttactactctgaagatcggaaagcaaccaagttaacaattgtccttgattcaaatcctaattcagctgcttcgatgaagaagtctaaagctattcagaagcaggtaaaggatgatcttcgtggaacttcgctgaaggatgcaacagttgcaatgggtggtcaaacctcacaaactgcagatattaataaggttgccggaaacgactttactcgtactgcggccattatgattgtgggaattttaattgctttaatgtttgttacccgttcaatcttgatgccattttatattatcggcacgttgttgttggcttattacagttccttaggaattactaaggcaatcagtaatatgttattgggacaatctatgttgacttggaacacaccattctttggtttcatcatgattatcgcgttaggtgtggattacagtatcttcttaatgatgaggtatcgtgattccaacaagagtttgaaaccaagcgcaaggatcttagaagcttcaggagtcattggtgctgttatcctttcagccatgattatcttgagcggaacctttgccgcgatgattccatctggagtgttgacgttaattcaagttgccttggtagttattattgggttgattattttaatcattatcatcccagtactcttaccagccttgattaagttaacgtacgaaggaatttcatttgggaaaaagaagaataagaataaacattaacttgtagttttctacaaaggagaagtgatgattttaaattgtcacttctcttttttgtatagagcgtacaatggagttatataactattttcgaggaggcgagatcatggactttgatccaaactgtgtattctgtcaaaaacaaccatcagattatgtacttgaaaacaaactcgtgattgcgttctgggatattcatccagttagcaagggacacttacttattatccctaaacggcatgtaacgcaagtttgggacgttacggacgcagaaaaagccgaactagtacaaatgatcgcagatgcaaaaaaactgttagacgccaaatttgagcctgatgggtataatgtcacaattaactctggtgctgcggccggtcaaagcgtttttcactgtcatattcatctaatcccgcgttattggaataaagtaactaaacgggttggcgcaattcctggtcagtttttggtacccaagtcgcgaccagagttcaaggatcttaaatagttttgatagcgagaaacaacaaaacgacgtataatttagttagcaaatgacgcaagcaaaatggggtgagcgcgatgaaaagatttaaaagattagctatttttattggaatatcagttttaggattaagcttggtattaacgggttgtgcgcaatctggaactgattcgggaagatccatcaaatccagcgcaccaaaagtttctaaagtgtccgccagcaaacaaattcggaataatagtgggttatggtatttttctaaatcagtaaaggccaagtccaattctggaatagaggcgtttgtgttttcaaaaaaaggaactgttgaagcttataacgtaaaaaagtactattcttcctattcagcagctaaaaaagctaagggtcttaataaatttggtaaaggaacttataaacttaaagtaaataaacaaaaacagacaattgtaactttaaaaatgaaactttctgggattcctgctacttatcaatttaagttaaaaaaggggttggccaaaaagtataagggactcatttttcatggctttaatgcagcccggactgttgatagcgatagtgtcaacggtgtgttagttcaagttagaaagtaaaaaagaagattatcgcaatttaaaatgcggataatcttcttttcttgtatcttgaagggtgaagtaagccggtgactcccacgaggatttaccaatgattttaaacccttgtgctttataaaaagcaagtgcgttggtatttttacgtacgcattttaaaataactggggcagttgctagttggcggacatggtcaattaactggcggccaattcctaaatgcatatattcagggtcaataaataaaagatgaacaaaattatcctgttcataaaaactaatgaagcccacaattttgtcatttaaaacagcctttaaggttaattcaccttttgaatcacgttcaaagtcagactgggtgggatgtttgacccacggaaaggtttcttgtcgtgaatgcagatacacctgggctaactgcaaagtatcttctgctttggcgggtaatatttggactttgttagtttgtgtcatcgcgtacttttcctttttaaatttaattttaaaaatgtaatttaactgcaatattgtcttcacaaaatattcacaatttgtgaatattattaatcatataaataactttttcatttactccccccataaagtgaatggatgatcatgtatatggtcatgttacttattttccattgccgcggcaacggtttttttgtacccaaaatttagaaacaccaaactggtttggaaaagagatgatctttttaaaccaatttttttgcaaaaaaccaaaaccggttttaaatatgcctatgtaagggtagaataaacacatgacactggatgctgcttattttgttactatttgtcgaaacgttagtgcataaagtgtgcatttattataaaaattagtagtatattagctatcgggggataattatgaactgggtacatattatcatagaaattattgttgcagtgaactcactagctgctattgtgactgtttttcgtgaaaaacgagatattgctgcaacgtgggcttggttacttgtcctcttttttcttcccgttgtcggtttcatcttttatgcgtttgcaggacgaaaactgcctaaaggtaaaatgtttcaattgagaaaagaaactaaaattgaattacaacgagttttagctcgacaaacacaagaattaaatagtgatcatacagcggctgacaaggttgttgaagatgcaagcgggatggcaactatgtttatgaatgcagattccgcctttttgagtcaccgaaatcgggtgaaactaattacggatggtaaagaattatttcatgaaatgttccaagatattgaacgtgcaaaaaagcatattcatattgaattttacacattttatgctgatgaaattggtcatgatgtactccatctattggaaaagaaggctgctgaaggcgttgatgtgcgtgttatctgggattcttggggatcaatgggtaccaagactaaattttttgatcatcttcgtgaacttggtgggcatgcttcaccattcttggggactcattcaccagtcaccgactttcgtttaaacttcagagaccatagaaaaattgtggttattgatggtcaagttgggtatacaggtgggttcaatattggcgatcaatatttaggtcgaaagaaaaaatttgggtattggcgtgatacgcatatgcggatcgctggctctggtgtatatggtttacaggctcgttttattcgtgattggaatgccactgaacctgagcactcaattgataaagtatttgatcccggttcaacctatttccctgtggccaaggttaatggtaataccagtttgcaggtggtcgagagtggcccggattcggatacagaaaccattaaactgggctatttgaagttgatttattcagctcatcgttcaatttggatgcagaccccctatttaattccggatgatagtgtgttggatgctttacgagtagcggcactatcaggaattgatgtgcggattatgattcctcacatgccagaccatgcctttgtttaccgtgcaactcagtactatgcacgacaatgtgctaaatggggtattcagatttataactatgatgctggattcttacatgcaaaaacgatggttgtggacggaaaaataagttcagtcggttcagccaatatggattttcgtagttttaaactaaactttgaagttaatacgttcctgtacgacgaaaaagtagctgaaaagttagaagatatatttaaagcggatattcgaaaatcaactttacaaacctcgaaaatgtatgacgaacaatcagcatggctgaagttcaagcaatatttttctcgcctgttatcaccaattctctaatttatttttaatttttagttgacgagaattttttggcgtggtaagatgcattcaacttaatatttaacgttaactttcataccaagtagctaattatctgggtgtcagaaagtcggtggttgctgcgaaccgatcaggataatttagatgaaataccatgaaacagtttcaattgaacggataataactagagccgttaccttctagtgagtggagagaatctgtttttgggattctttcaatttgggtggtaccacggttttatcgtccctgttgtataaattacagcagggacttttttgttccctaaaatttggaaggagcggcagaattatggaaaaacgaacatgcggaggaatgcctcgttattaaggcttccttagaaattacaggtggtcaaaatttttaagaaaactaaaaatgaggtgcaatatgaaaaataaagtgagttttaaagaagcagttattgtgttgttagcaatgttaatcattatgggattaggcgtaattaagttcggtttatcgccacaagtacccgtattattggttttagtcgtggttacattttgggcgcggattcgtcactttgcctggacagatgtcgataatggcattaaagaaggtattcaaaccggaattattccaatttttatttttattcttgtcggcgcattaattagtacttggattgctgctgggattattccttcaatgatggttctaggattccacatgattagtgtcacttggtttgtgccatcggtattctttgtttgtgccttggttggaacttcaattggctcagcgttcaccattatttccacaattggaattgcctttttcggaatgggtatgacaatgggtgtcaatcctgcattagttgctggggcaattatttccggcgcaatctttggtgataagtcttcaccactatcagattccacaaacttagcttctgccgttgtcggtgttgacttgtttgatcatattaaaaacttgatgtggtccacgattcctgcctttttaggctcattgattctttacgccatacttggttttcacgctacatcttctgctaatttgggaaagattgatcaaactgtggcagttttacaagcgcactttagtgttaatttctgggcaattattccaatcgctttgatgttcttctgtgcttggaagaaaattcctgcaattccaactttatttattaacattgtcgtttccgtgttgatggtattcattgaacaaccccaaactcaagtaagcaaaattgccacgattattgaaagcgggtttgtatctaaaacggggaatgcaagtgttgatgcattattgactcgtggcggcattggtagcatgatgggcactgtttccttaattatccttaccctgtcgttaggtggccttctaatgaagtttggcttgattcaagccgtgatggagcccttaacaaagcacttgaactcagacggtaaaatggtcactgccacaattctttctggaattggggtcaacatctttattggtgaacagtacttatcagtgattctaccaggaaaagctttcaagaaggcgtacaatcaatctgggttagctaaccttgccttgagccgtgtccttgaagatggcggaacagttatcaattatttgattccatggggcattgccggcgcttttgccgcaaatacattgggtgtttcgaccctccattttctgcccttcgcattttttagcatcttgtcaccaatcttctcgatcattagtggctttaccgggattggattgaaacatacaactgacgaaaaaaaaacggcaactaaagagaaactcgttgctgattctgaaagtagtttgaactaaaaaagactaggattatctgatcttaaagctagttaaacatcaaaatatgatttgccataatgttgcagtaagacttgcgaaaggttttgggcgatgatcttagagccgtttaggtcgggatgcacgccatctgtataagtgattggccaagcgcttgtttcaattaagtaaattagttgaggaaatcgatcggccaattgcttaagttccttagcaaaactctgattaaatggaacaaagacatttaaatgagcgtccggaaatagcgcatgaagttcttggaaaaaatttaagaactgttcttggacgagtagagcttcaaaacggcggtcatttgtaccaatattcacgatgacttggtcgggatggtaggctggggcgggcgtttcaaaatcgatatatttcacaaatcggggcgctaccggcactccaccagtaccatagcgcaacaaaccagctgcactataagcgatacgaatatcttgcgcattaagcaatctggcagtctgtgcagcgtagttttgttccgctgcatagccagaagaagggatgcgttttaacacccaacaaccagctgtaattgagtcacctacaaacgcaattgttctaccagcaggcttaaccgcaatgagatttccggaagtaggcacggaaattgaactgattgctaagccttgctgatgtaaccagacctcatctgcatctgaatttcccgcaaaggtaatccggatcagatggggcttttttgtttcaaattgaagttcgctatgtacttcattgaccttcaatcgaagctcgggctggtcatcaataaagatggcgatttcgggctgaaatttagaagtgggtgtggtatttaaaaacttaagcttaagccgtttggtgtctttagtcatcattagtaaagaggcacctaagtttgtggtgtacatcacggattgattatcaatcgttttaggtacccaacgacccataaaataaactccagagaagagcccgttagccttggcttcaacgtattttgcctgtgtcataatttgttagctcctctgtaattaaaattaaccaggattatccatacaactgatttcatgatcgtttactagtccaattgcttgcataaatgagtaagtgatcgtgggacccataaacttgaagccacgtttctttagatccttagcgattttctcggagagtggtgttttagaatgaatttcgacaggaatgcggatgtgattatttacctgacgattattgacaaattgccaaatgtaatgatcgaaacttccaaattccttttgaatttttaaaaatgccttagcgttgctaactgtgtcttgaatttttaaacgatttcgaatgatgttgggatcttggagaagtttttcagtatcttctgccgtcattgcggcaactttgtttaaatcaaagttggcaaacgccttttgaaaagcagggcgcttttttaaaacgagttcccagttcagcccggcttgaaaaatttctaaactcatcatttcaaaaatatactggtcatcgtgggctggctgacaccattcatttttatgataggcgcgaatttctgggccaccagttttcgcccaagtgcaaataaaatcatctaatgtttgtttcatttcatgttacctccgctggttgccagtgaggtgggaatctgacaacgattaattaactttattatatcgcattttgcacaagaacttgacttattaaaatttgatgatagaataaatgcattattaatattaatgcgatgaagagaagagtaagtccagcaattgcttagagagttccgattggtgaaaaggaatcgattgtcaggattgaagatgagctcagagctaatgtttgaggtgcaagctttaaacacgtgaggatacgatataatcccagatataagtttagtttacgtttgtatcgttgaggtgctgtttgtgagaagagcataaacatgggtggtaacacgaagttttcgtccctagtcttttaattaagacatagggcggaaactttttttattgcaaaaaagagggtgattggatgactgaaactattattgatttaaagaaaattacggtggcatttaaggatggtgaaaaccaagtccaagcagttaaggacgttgacttacaagtggaaaaaggtgacatctatggcattgttggttattcaggcgctgggaaaagcacattggttcgagtgattaatctattacagaaaccaacatctggtgaagtgcatattaataaccaaaatttactgaagttaaagccagttgaattacgccaggcacgcaccaaaattggcatgatctttcagcactttaacctgatgaaatccagaacaattttaggcaatgttgaatatccactgttgaagacaaagctatccaaaaaagaccgcattcaacgggccacagaattactaaagctggttggtttagagcagcgcaaaaatgattatcctcgtcagttatctggcggtcaaaaacaacgagtggcaattgcccgggcattagcaaataatcccgatattttgattagtgatgaggccacaagtgccctagatccagaaacaaccttgtcgattttaaaattattaaaacgcctaaaccaaactttgggattgacgattgttttaatcacccacgaaacgcaggcagtgaaagaaatttgtaatcacgtggcggtcatgcaaaaaggcaaaattgtggaacggggcaacattgaagatattttctcaacgccgcaaaagaagttaacccaagaattcatcaatattgcgaccaacgtgggtccggctgttgaaaaagtgacggaaaatccaagttttaaactactcacgcaaaaacaacagttggttcaattgaacttcattggtcattctactgaacagccgattatttccactttagcaaaacaatttgatgtggatggcaatatcttgtttgccaatgtagaacaactgcatgaggaaacattaggattcatgattttagttttaacgggtgaaagcaaaaatattgaaacggtaattcagtttctgaaagaaaatcaagttcgggtaaaacgacttaatgaagtgcccaaaagtgaggtgcaaagctaatggcaagttggtttccaaatgtaattcatatgcaaacagaatttgttcaagccacatgggaaactgtgtacatgacgttaatttcagccattattgcgggcgtattaggtctggcaaccggtattttcctgattgcaagtcagccagggggaattctagaggacagcttcatatatggtctcctagataagattgtaaacttgttgcgatcgattccattcataattttattggctgttattgccccgtttactcggtacttagtgggtaccacaattggtacaacggcggcattggttcctttgattattggaatttttccattctatgccagacagattcaaaatgctttaacggaaattgatcctggtgtggtggaagcagctcaggcctccgggtcaagtcccaccgaaattatttttcgtgtgtacttgcgtgaagggttaccagatattatccgagcttcaattttaacgatcattagtttaattggtctaaccaccatggcgggagcaattgggtctggtggtttaggtgatattgcaattagcatcggttatgcgcgatttgaaaatgacgtcacaatggtcgcaatgatcattattttagtcatggtgtttgttatccagttcgttggggattggttagcaaaacggttagagcattaaaagaggcgatcttaaatgaagttcagagatagtgtgggaggattagtacgaatgtggtttgagcaactataaacaataataaagacaaggggagttagatatgagaaaaagtgtttggtgggttttagggataattgtggtattagtcgctgtagtggttgggattcatcaaataagccactcggctaaagctaaaacagaaacgattacagttggttcaatgggttcggattatgacatctggaagcatattgccaagagtaaggatgctaaagaggcaggtttaaagattaaagtacagcaggtcacagatggtgtgcaactgaataacggcacggcgcaaggcaacattgatgtaaatgcgtttcaatcttattcttactatgaagcgtataataaacaacatcaaaaacaacagttatctgctttaggaaccacttacttggagccaatgggaatttactcgaaaaagtatgaaaaagtttcccagattccggatggcgcaacgattgccattgccaataatcccgctaacacggcacgcgatttattattgttgcagtcagcaggtttaatcacattgaaggctaattttagttcattaggtaatgtgagtgatattaagagtaatcccaagaatctgaagttcaaagaaattgatgacacaactggaccacgcgttttaaaggatgtggatgcagttcttatttccaatacagtggctttggagggccatctgcatgtactttcagattcgatttttcatgagaaagctgatcaaagtacgcgtgctaatattaatattttagcaactgccaagaagcatgcgagtaacaagcaatacaaaaagttggtaaaactgtatcataagaaagatattcagcgttatatcaaagataaatattacggcactaaaattgaagttcaaaaaccgatttcttatttgaagtaaataattaggttaacaagacatctcagcggttattaagtaaccgcttgaaaaaaataattttcggatgcaaaatagacagtgtatacatgaaaggaagtttctaaattatggcaaaagttgaaagttttacattggatcacacaaaggttaaagcaccatatgttcgtttgattacagttgagagcggtgcaaagggcgataagatttcgaactttgatttacggttagtacaacccaacgaaaatgcgattcctactgcaggattacacacaatcgaacatttattagcaggtttgttacgtgaccgtttagacggcgtgattgattgttcaccatttggttgccggacaggttttcatttgattacatggggcgaacattctaccgaagaagttgctaaggctttgaagggctcattagaagacattgccgacaagatcgaatggaaagacgttcaaggtactgacaagtatagttgcggtaactaccgtgatcattcattgttctcagccaaagagtggtcaaaagccattctcgaaaagggaattagtagcgacccattcaatcgtcaggttgtttaatatataagtgaatacgaactaaaagaggctggaaattctttccaacctcttttttacacttatttgactatctaattagatttatgaacttcagattttgactcatcaccctgcataccattgaaaaacaaattcaaaacgacggcgacgatgctggcaacaacgattccattcgtgagtaacatccgcgcggcagttggtaaaaattggaaaatttgtgggtaaacggtaactccgagtcccattccaattgacagggaggtaattaaaatatttttatcttttgaaaaatcaacctgttggagaatcttaacaccttgggcaccgacaattccaaacatgacgatcatggcgcctcctaaaacaggatcaggaataattgtagctacagcaccggccttgggaagcaatcctaagataattaagaagaaggctgaatagtagattggtttacgagtttttactccggaaagttgaagaacgcccacgttttccgagaatgtggaatatgggaaagtattaaacagtccgccaagcatagcagcaattccttcggcccggtagccccgctttaaatcatcttcttcaatttttttacctgtcaaatcgccgagggcaaagaaaacgccggtggattcaatcattgtggttaaagaaaccataatcattgtaataattgcggagccgtgaaaagttggggttccaaagtaaaatggttgaggcaaatgaaaccagctggcctgggccacgggactaagtgataccatgcccattgcgcctgctaataaggtaccggcaagaatgccaattagaattgcaatcgaatgcataaatccttttccccaaatgttgacggcgacaatgataatgacggtgacaaaaccaatgattaaactcttgggatccccaaatgatttggaagaaaccgtaccgccacccagattctggaaggcaactggaattagggtaaaaccgataatggtgattaaagagccggtaacaacgggcggaaagagattttttatttttgaaaacagaccactaattaagaaaacaaacaggcctgcacacataatggcaccgtacatcgcaccaattcctagagccccaccaatattttgcaacggttgaacagcctgaacggcacagccaaggacgacgggtaagccgattccagttagcgccgttttttttagttgtaagagcgtggcaatcccacacatgaagatatcaatagagactaagtaggtcatttgagaagctgtaaaatgcaagtaaccaccgattaacaacgggactaaaacatctccagaatacatggctaagaggtgttgcaaacctagtaaggccgctttgggctgtgagatagtttgaattggttttgcatgagttgcttcaatagacttcaatttagttctcctttcctgtcacttacaacgtataaattgagaatatgaaagtaaaacaggccacaacattgctgttgtgaacctgtataagtctgtcgtctattgttaaagatacgccaaaaaatagctatctaaaacactattcgcccatagtccaacatttaaggtgtcgggtagaaacttatcaaccatattatgacattatacaggtaagtgctattaaattctgtggtgcctagtttagcatattgtgttttgattaacaactggtaaatttcaaagaaaggctaaatctaaacggcaattttactttaatttaagttcattgaacgctttgattaagttaaattaagctagtttttgtaagccatcacgaataattgcaatcccagttttgatttcttcttccgtgattactagaggcggttgaaatcttaaaatgtggtccatagtagaaatcatgatcaggccatgttcaaaacagtactcacttaaggcggtcacaaaagcagatttagtggcttcaaattcaataccgccatttaatccgatcatgcgcacctgtttgataattggaaagtcttgttgcaattctaaaaattgggttttggcgaactcccccaattgttgcgagcgttgaggtagatttagcctttcaacctcatctaaagttgccaaaccagctgcacaacagattggattggctgcagtagttgtggcatttgcaggtgaagctagactatccatgattgggacttttccaatgacagctgaaagtggcataccagaggctagtgattttccaacagccatcagatcaggctctaagttaaaatgatcaattgaccacattttgccacttctgccaaatccttgattgatctcgtctgtacaaaacaaaatcccgttatcatggcagagctgatacaaaccttgcatatagtcattgggtggcgtgatgatacccgcatcaccttgaatcggttcaatcagaatggccgcaatttggtcggcaggaatatcatgttgaaacaaatctcgaaggtcgtccagatatcgtttcgaaaaatctgccaaggtttcgtttggaaatcttttttgcggatccgggaatggtaaatggtgaatatctggcactaatggaccgatatctctatgcatattggcatcaatggctgaaaggcttgccgcgcctaaagttgtgccatgccatgaattttgaaacgttaaaataacggaacgtttggtgtagctgcgggcaaatttcacaatcccttcggctgcttcagaaccagaagtgctaaacgaaacctgctttggcgagtttccaggtgctaggagtgctaggcgtttagcgagttcgattgctggttcatggtaaaagtagcctgaaatatagtgaacaagtttgtcagcctgttgctgaattgcggccactacatgggggtttccatgaccgatattgactgccgaagcacttgctaaaaaatcaatgtaactattggcatcagcatcccacacagtagcgtctttagcgtgatccaccactaaatcaaactttgaaactcggccggctggagccacgtattgatgatccagcgcgatcaaacgatggcgatttggatttttttcgaaactcatttacaacacttcccatagtcattaatttgaattgattatagcacagcaatttttgtgagttcgttttataatgaagttacgacatatatgaggagcaatcgacatgaaacaggttttggttatgggtgttggtgatagagttgggcaggcattttttgaagcttgccaaggcgaaaaaaataacgaacttcaatttaacttcattgaagaagagggaaatattccagcaggttttcaaaatattcaagttgttgacttacaggacgctgaacaactaactgcccatttgacacctgcagatattttggttattaatgtgagtggctgggacgtagattacgtcttggatgcagtaatggatgccattgaagctcatcaaattaaattagagaaaattatttttcgatccgtagccggagtcaatgatgaatatccaattaaaaatattcaagcagtgacgcacgatcaagaagagtttgtaaaacagcaacagtatgcgggcaaactagtcgacgaatcagaaattccgtatactattttgcgtccgacaaatgttttagattcaactgatctaagttatcggcttgtggatgaagggaccaccatggacagtgcaaaagatgtgggtgcaaaagccgtcgctaaggtaattttagaaaccgtcaaaagtgatcagtacaaaaatcaatccattggaatttgtggctgaaaaatgtggttaaatcaagtataataaaaataaaacgaacatacgtgcgtatctttttgataggaggttcttatgactttaaaatttattttaggtaaggccagtcgtgatcaacgacaggcgatgattgatgaagttggtcaagttttggaggccgattcggaatcacaagtttattacattgtgcctaatcatatcaagtttcaatctgaattaactgttttaaatgctttacgaaaaaagcacaacggaaacgaggccacctatgcccaaaatcaattgcaggtgttctcgttttcacgattggcttggtattttatgaaaaatgaaccaatctatcaagtgccaagattatccaaggctggcataggaatgttaatcgacagaattattttggaacatcaagatgaactgacggtttttaatggtgaacagacgcaaacgggcttcattcaacaactagctagtcaatttgatgaacttcaaaagggacgaatcactgctgaggattttgaaactttgacccaaaaagttaatgctgacgaaaattccacaattgatttgacggccaaaatgcacgatttagcaattatctatacagcatttgaagaagaaatgttgggaaattatgtcgatagcaatacgctcatggaagctttgtgtgagtacttagccgagcaagatttaagtcacatggtgtttttatttgacagcttttcgtcgcttacggctcaagaaatgaagttagtgaaagtcctcattcaaaaatcaaaagcagtgatttttagtttgaccctggatcacgcttacacggattcgaaacctcaagaagaagatcttttttacgagtcagcaaagacctattatcagctgtatcattttgcgcacgcaaacgccataaaaatcaagacagatagttttgcagatcaaacacgggtgagtgctgaccttgttaaacttgaaaacttctggctccaggcgtctaacatgcaggattctcaacccgagagtttaacggatgaaaatagtattcaaattaggcatgcagatagtcgccaaactgaaattgaacaggtcgcacggcagattagacaaatggtcgcaaacgatccgcagattcattatcatgattttcttgtattggcgcgccatttagatacttatgaaacagttttaacaccagttatgacggaatatgaaatcccccattttactgatttgcagatttcaatgaaggatcatccgtttgtagctttaattgaagctttgtttgcagtaaagtctcattattatcgctatcaagatgtgatgcgcctcttgaaaactgaattacttattccaaaaattgatgataaatttatggatattcaagcctttcgccaagcaaaggatttaactgagaacttagttttgaagaacggttatgaaggtggcaaatggctgcaaaaagatgactggcaatatatgcggtttaatcccagtgattttggtattcagtctgatcgtgacattgcgattactaaacaagtcaatagtattcgcaattacattcggcaaactctgccaccgtttttcaaagctttggatcaggcaaaaacaggtaaggaagctgtcactgttctctatcaatttttgattaaccaaggcgtgactgagcaacttaaaaaatggcgtgacacagcggttaatgcgggtgatttagcgaagggtgcccaaccagaacaaacctggcagaccttttgtgacatgttagatgagtacgtagccattcttggggatcgcgagtttactgtggataattttgtggcattattggaagctggttttgaaggtgcttcctattcattaattccatccacattagatcaagttatgatttctgaaacagggatggcccagatgaatgatcgtaagtacacctttattatcggggctacagatgcggtgatgccagagcggtttaatgatcaagggatcttgtcggatgatgactatgcagctctaaaagacgacttgtctgacgaacaattttttactgataatacgaatgaacaagcgcattttgagcgatatttgaattacgtggcgttcctgtcgggatgccaaacagtaagcttctcgtacgcggataccgatagtgacggtatcgaacaaaaattatctccgtatgtacaagaaattcgtgatcattttaaaattgaagttcagcggagttttgatcgccctcgtttagatgaagaatcagtcagtgagtttttaggctcaaaacgaagtacgttaactcacctgctacaggtgagccgtgatagtaaagatattcaaaaaatgattcaacctaaatggcagtatatttatcgtgtcttaactaccgatttgcagttacgtcacctaaccaaccgcgtatttcaaagtctgaattataaaaacgaacccgttaagctccaaccagaaattgtcagtgatttatacggggataccatcaatacttcaatttcaaagttagaggaattttatcaaaatgaatacgcctatttcttgaaatatggcttgaaactgcaggaaagggatgtatttgaactttctccagcaagtactggtgaatatttccatatggtcttagatcacttcgtaaagctgattaaccaggaacaagtggatattgccaatctgtctgattctgagatggaaaacttcttaaatgctgtggttaaagatatcagagatgaaccccagtttgaaattttaaaaagttcaaatcgcatgcattatattaacaatcaattgaaccaaacaatcaagcaaatgttgaaaatcttcgtattgcaaagttctagttccaagatgcgtccaattaagaccgaagttctgtttggtcaagttgggtcagagactggcataaagtccttagattttgatgtttcacctactcagaaggtgcgggttcgaggcaagattgaccgaatcgatgaacttaaattaacttcagaatcgggtaaatcaagacagtattttggcattgtcgattataagtctagccaacacgatttcaattttcgggatgcctattatggtttggcaatgcaaatgttgacctatattgatgctttgaagaaaaatattgccttaattgatcagcacgcagtggatccattgctatcaggggcactgtacatgcatttacaaaatccatccgttgatattgctaagctaaagacagcagatcccaaggaagttcaagaggcgctattgaaggacaccaaatacaaaggcattattttaagtgatccggaattattagataatttggatacgcgattagattcaggatcctcgttaatttatccattcagcaagactaagggtggtaagtacggctcaaggagtaatcaaattgtgacgaaagaagatcttgagcgtttgattaagcatgccgagaaaaagattgtggaagctagtcgaaaaatttttgctggtgagttgaagttgaatcctgctcggtggacggatcaacacacggcattacagtattcaccatataaagcgattatgcagtttgatgagatgcttccggaaaacaattatcataaattggaaaattacaaagcaaaagatgttctagaaatgttaaaggaagaagatgacaagcatgggcaaaactaattttacggatgatcaacgacatgcaatttatcatgatggtcataatgtgcttgtctctgcttctgcgggttcaggtaaaacgtcggtattagttcaacgtgtgattgagaaaatcctgaatgggacagatgtcgacaaattattagttgtgacttttactgaagcggcagctaaggaaatgcatgatcgaattcaaaaagcgatcaatgatcaaattcgcgtcaaaaaggaacctgctcaacggcagcatttagtttcccagctcacaaagctaaatacagccaatatcagtacaatccatgcgttttgtatgtcaattatcaaacgctattactatgtgattgacttggatcccattttccgattgctaacagacgaaacagaaggaattttgcttcgtgaagaggtttggggtgacttgcgtgaatcattgtatgaaacagatggtgatatttttgcacagttaaccgccaatttttcaaatgatcgtagcgatgatggttttactgatttgatgctgaaactatacgattttgcaaatgcaacccctgatccgaaaacttggttatacaagctttctcaaccatatcagattgatggagatctcgatgatacttcgttttacaaagaacaggtcgttccggttgtaaaggatgagctaactaatagtttggaagaagcccactctttacaagaacttattcaaaatggttcagaagatcttgaaaaactgcgccccattattgatgctgatgtgaatcaaatgcaagaaatcttagatgacgggttatctgattggaatgatttgcgaggaaaactccgtagtttagatttcaagagtatgagcggtggtaaaagaaacgatgaagtaaaagaatttaaggcgcgtgtcaaagaggtgcgtggggatacaagccataaaaatgggtacaaaatgcggattcaggaactgacgcagaagtatttcagtttagacaaggaccagatgacagaggtcatgaagcggtctgaagcactgattacagagttaggcaaagttacaagtgcctttagggatgcctacgctaaagaaaaacagcatcgacagattcttgatttcagtgatcttgagcattttgcaatgcaaattttgaatggcccgtcagcagagtcaaaaagtgctcgtgctgcttatcaaaaacaattcgaagaagtcattgtggatgagtaccaagatattaatcccattcaagaagctattttgactagtgtgactactgaagatccgggtaacatgtttatggttggggatgtcaaacagtccatttatgctttccggttggccgatccccatctatttatcagtaaagatcgtgcttatcaatcagatgatgtaacgggagaacgtattattctgtcccagaatttccgttcggttaaaaacgttgatgcattcactaatttaatttttgaacagttaatggatcgtaagttgggtgaaattgcttatgatgatgacgctaaactggcatatggcgcaatatactatccagaaaaagatcataagggagaagcaatttcaaagagcaccgaagttcttgtttatgatgatgagaaacagaccagcagccagccaaacgatgaagttgaagcaggtagttttgaaatcgatgataaatcacgaggacaagttgccattgcaggccaacgaattaaagagttaattgaaaataaaacggaaatttacgatcgacaaattaatgactgtcggaaattaacttatggggatattgttttgttaacgccaaccagaaaaaacaatttaactatcgtagcgttgtttaaacagatggggatcccagttgtggtaaatgatgcacaaaactattttcaaaccaccgaaattgccattatgatggcattgttgaagattattgataacccttatcaagatattccgttagctgccgttttgcgatccccaattgtgggtttgaatgaaaacgaattagctttcttacgaattaataatcggacaggagactatttccaggcagttaaagattttcagagtaattttaaggataacgaaacgaatgaatttcaaaatcagttatttgcaaaggtaacacactttttggaacagttgacgcattttcaagatattgcaaatcaaaatcaattagccactttgatttggataatttatgatgaaactggtttcttggattatgtgggcggcatgccagctggtcagcaacgtcaagccaacttaaatgcgctatatgatcgcgcaagaagttatgaacaaagcagtttcaaaggtctatttcaatttgttcgcttcattgaaaggatgcaaaagcagagcaaagatttggctgagattcctgtgactagtgatgaggctgctgtaaaggtcatgactattcatgggagtaagggtctcgaatttccagtggtatttttgatggatgcgtctcatcaatttaatacaacttctatgaaggacaggtacattctggactcgaaagctggaattgggatcacctatcttgacccgaatacacgaataaaagtagatacaccacaaaaactatcgattttagatcaggtaaaacgaaatagtttggctgaaaacatgagacaactttatgtggctttaacccgtgcccaacaaaaactcatcattgtgggcgcctgtgacgctcaagaaaaaatcttaaagaaatggcaaacagcttcacgcagtaaagagctgttactgacagaagccacacgattaaccactcataatttcttagactggattggagaagccctaattcgccatcctagttttgatcaaggtagcgaagatcaaacccaacttgctgaattaagtggagatacgactaagtttgaagttcagtttaaaacaaagacagatctgcaagacgttgccgttatgcaggctgggaagccccaaaaagattggtggcagaaatttcaaacggctacacaaaaattagatgtcagtgatctaaatacgtatcaaattgatcaagttttaaacttcaaatatccgcaccaggtagcgactgaaacaactgcgtatcaatctgtatctgaagtgaagcgattatttgacgatccggatagtttggaaatgacacagtccactgttgaacgcgatcgaaagctaaaagtgcagaatcaatatgtttcaaatgagctagcaacaccaaaatttttacaaactactgccaaaccgaaaccaacagaaataggaacggccacgcatttagtattacaagaaatctcgttaaaatcgaagcctaccgaggatagtgttcgggatctgattgctaaactggttaccaacaaagtattgagcccagaagttgccaacttaattgaagttcagaatattttacgattctttgattctcagttgggaaacctattactggcacatcctgatcgggttcaccgagaagtaccattctcactactgatgccagctaaccaattatttagtggttttaaggacttctcggatacagaagaaacgcaaatcctgattcacggaattattgatgggtatgttgtcatcgataagcgaacaattttatttgattataagacggactacgttaaaccgggaagcacaaaaaatggagttcaaaatatcattaatcgttatgccggccaggttaatttatacgcggcagcattgacagatattttaaaactcccagtagaggaacgctatttgtatttactttcaattggtgaactcgttgaagttcattaaataaatcactttatataaaaagttgataggccagtcgtaactcagatggatcgtggtccattaatactgttccgcgatagtcaaagccacttttggttattaagtgttgcatcagtttattatcggggtgagtatcaatgcggacctgatggtagccaaactgacttgaaagcgtgagtaatccagagatcatcttttcagataagtgttgaccgcgaaaatctgaggacatggcaatacgatgaatagcggtgtatttagcatccgcggcaccttgccaagcaccatcagcgatcacatcgtaatttgaatcatgatcggggagtaaggctgctgttcccgcgatttgattatcaattatcagcacatagccgatttgatttttgacatcggcttcaagtgcctctgagtctgggtagccatcctgccactgatcaatgccttgagctttcagaaattctttagcagatgtaataatttttgaaacagttggtaaatcttcaagggttgttttgcgtaaatatgaaaccgtcaatgaagccacttcctcaatgttttttaaaaatcaattttagcgcaatttaactacgctgtcattaaaatgattaatatacggtaaaaaagcttgtttctgtaaaactgaagttcagttttctggagacaagctttttcgatgcaggtaaattttaccttttgagggctttgcttgtttgatagaaaaatgcagcaaaaagatagcattagaaaatcaatctgatttcctaatgctatcctttttagcctagatattatctttgtcatcaacgtgcttgttgatctttttagctgctttatcttttacgtcagcagccttatctttaagcttacctttttctttttgtgttttaccttctaactctttggaatcatcgtgggtcattttcccaatagtttctttggctttaccagcggccttatcttttaatgcgtctaacttatcattagcttttgacattttgaaaacctccttatggtttatataattattatctttgattttgggggaatcgtcaatgtgtttgcttatgaatggaataatgttggagtgtaaatagttgaaactcaaactgtaagtattataattacaattgaaatcaagaaaggggttttctaaatgagtaaagttattattttgggggcagctggacacattgcacgcctggccgcaaagcaattaattaaagaaacagatgatcaattaaagttgtttgtccgccatcctaagaagttgaccgatgttgataagaatcgtgaaacggtagttgttggtgatgtaaataatgaatcagaattagcagctgcattaaaaggacaagatttggtgtatgccaacttaggtccggatgatacggataaaatgattcctcatattgtgaatgccatgcatgaagctggcttgaaacggttgatctggatttcaactttaggtgtgttcgatgaggttcctggtaagtttggtgattggaataaacaaatgctcaatccgagtggttatcttccaactcaatccaaggcagctagtgaaattgaagcttccgacttggattacacgattattcgtcccaactggttaacaaataaggatgaagtggattatgaagtgacgggccgccatgatgagatgaaggggactgaagtttcgcgtaagtcagtagcagattatgtggtcaaacttgttcagaatcccaaaaaagatgttcggacatctatagggttaaacaaaccaaatacagatggtgataaaccaagtttttattagaatttataaaaaatgatcaattgaaagtcgggtaaaattccgaatcaattgatcatttttttaactattaaattatttttgacttaaaatcatgggttgctggatcatattcgtgtttataaagtaagttttcgtgtttttcgaagaagacgttactgtattggggatcaagatagaaaaatgagctatcttcaccgtttttaaacaaaataccggcctcaggatccgtgacttctgtcaatgaggcagtgggagttgctagatgagaagcgatatattttttaatcaatcgatagttcatggttagttttcctcgtttgaaattgtattagtcgtcgttgtttcatcagtgttgagaatgtatttactcaaaatatctgacgaaattccgggcgtctttttgatgataaattgcgccacttgtgaatctgaaagctgggcttgataagtgtcgttgggcagaaattggctcacaattaatagaataaaaatgacaaaataagcaatcacaaggctaataaggccacctgccagtccgttgacttgtttaatgaccggaatccatgtgattaaacgggaccagcgtgcgattagacgcactaatagccagccaatggccatgaggatgaaaaatgaaacggagctcatcatggcagtgctgctggtggagctttggtcactgctaaaagttgtggataggaactcggcaactggcgtacaaaggactttggcaaagataaagacggcaaaataaccgattgtatacagaagctcgataacaaatcctttatggagcccactgatgaatttccataataatatagcaagaatgataatcgagagaagcatcacgcaacctcctttaaaatgaatactctgaatttaccatatttcacaaagaattgcttgtgggtagtggaaacttaatacaatttaaatgagtgtggcaaggatgtgggagattgctgggaatgaaaaatcagtatccatagaagctgtaatggataccgatttacatatattgtatcagtcttttcgagtgcttcctatagttttgagtgtaccatcttttatgggttcagatgagcattctaaggcagattcagcttgtttttcatatggggaattgtatgtaactgtgaaggtaaagacacgtaagggttgatttttatttttgctgttactgcttgtcaaaaaacagcaaaacgtgtaccattgttttgtaaacaaaaaagaactagggatgttcctccccagtccgtgtggtcagtatatgcttgcaacttgtaaaataacttgttagcgctgattgttaatagattgctctatcttaaaccgttgcctccaagcaaagcggttttttattttgtctacaaaaccttacataccataagtgttaaacacaacacgataataataattgtacctaaaacaccaaactgtacacgttctgaaagaccatgcatagcattaatagtttcagggaaccatctaaattttggtaacactggatagacgctgtccccagtactccacataattaaatgtcaaaacaaaaagtttttgcattggcatcgcctccgtttttaaatttcagcgctaccatgcaatttcacaaatacacttatcacaataataaggatagcacaaaaaaagttaaaataaggtcttgaaattaagtggtaaatggtattggtttttaagattaatgttattgactgtcaccacaaaaaaattgttatccaaaatggataacagttattcccgaccgcaagggcttattaaattatcttaagttatttcgtgaatgtcctttgatgattaaaaaacaatacaaaactaaataaaaagactgatacagcaggcatttaagccacatgtctgtatcagtattttcctatcaatggaccctaacggatttgaaccgtcgacctcttgcatgcgaagcaagcgctctcccagctgagctaagggcccaaaaagcttacttaattagtataccgcaaaattagtgaagagagaattcaaaatttaattgaaattttggaaatgtttttgctttatgaaaatcattgaattatgattcttaatcaactattgaattataagtatcaataaaattaatgtatttagctgacgcgcccgtgcaaatgcacaaaattaccaccaattcaaaacgattttcacattttcatcatcaaactaagatataataaagaagaaaagggtttcactaattgaaactattcaaatggtgaagcgaccactttaatataaaaagattgattggagatgatgacgtgcatacaaaaaaagctttaaaaatcgccggcatatcgttgattggtgtggcagccagcctaggaatcagcagtttagtgagttatcagatgggaattatcaattctgatgcgcataaacgacgcgcaattcggaatgctcgcagtaaagacaacacgccagacacatataattggtataagcaactgattaagcagacgtggtttattcgtgcggaagatggcattcatttagcggccgcctatatttcaaacaatagtgataaaacagtcattctcgcgcatgggtaccatcatgcccatgaacaaatgattccgtatgctaaattatttatggatttgggctacaatgttttgatgccagacgctcggggccacggagtaagtgacggaaatattgtcggttttggctggctagatcgacgtgactacattaaatggattgaagaaatcaattcgcgtagcaaaacacctcaacaaattgttttatttgggatcagcatgggagctgcaaccgtattggccacggcaggtgaaaccgatttacctgacaacgtaaaagctgtggtggaagatagtggcttcagttcggcccagaaagaatttagttatcgtttggggcatcatttttatttacccccattcattagcacatttgtgagtttaatgacgcgagttactggcggttattccttaaaagaagccgatattgcgcatcaagcgtcaaatatcaccatcccagttttgatgattcacggggatgccgaccgttacgtgccggttgaaatgatggcagaaattaaagcatcactggcaaaacaattgcctaaggaaagtcatgaagttccgggcgcagatcacgtggaatcacgcttaacagatccgcaaaaatatcaacagaccattgcccatttcttgaagcagtggataaaagaggcttaatcaatgaaggattgcatccacgaaatattagggtgcaatcctttactgttttttcatgtttaacttttataaaaaatcagttaaggtcgcaatagggctggtttatgtgtgaattcatatgttaaactaattcgtaatgattacaagttaagtgtggtgaattcaaatgacagaaatacgaccgagttttttgatggtggtaaatgtctttgcgggagcagggaaagctaagcatatctggcaaaaaattgaagttcaattgaaggaagaaaaggttgattatcgggtaatgatgaccaaccatcctggacatggcgtccaattggcgactgattttgccctccgtcataagtatgatgcaaaatgggtcgttgtggctgttggcggcgatggaactttacatgaagttttaaacggattgcatcgtggtgggggcgatcaaattccattaggttatattccggctggatctggaaatgattttgcccgcggaatcaatttgccaactcaaccgttagtggcgttgcaaaaacttcttgaagttcagcatgcgactagcttagatgtgggcgcctatcaaaatcgattggattcacacgccactctgtttacaaataacgtgggaattgggtttgatgcttcggtggttcatgctgccaatgctggtcaaaaagaccatttgcgtaaatatcatttggagtccggcgcatacgtctcttctttaattaaaacctttttcaaacaaaaatcctttggtttatctgtaaaaacggaacaggatcagcaccggtttaatcgtgcgtttttggtcacgaccaccaatattaaatattttggtggtggggttccgattatgccaattgctgatttacatgatggtaaattggacttaattgttgtggaacaaattggcgtgttacgctttgtaaagctattcggtgaaatgctgactactggtaatcaccttaagtcatctgctgttcaccattttcgttcgcaacgattacatattcaaactgatttacctgaaaacggtcaggtaaatggtgaaaatattcaaaagcaaaaatttgatctgaatttttgggtaactcagcgaccattttggattagttaaacatttataagtaatgactagcgcgtttagacaatcgttgtctagacgcgttttatgtacacacgtagagctttcttttgccctcataaaatagtagaatgagcgatgttgcctattaagtagggtggcaacctaatttaaatgtaaatgggggatttaaatgaatgcagcaaccatttttgttcacggttttaatggtggcgtgggctcaacaagtcatatgatttcagcggctcaacatgcaggttgggccaaacaaatcatgacggcaaccattacgcgttatggtcgaatctctattaccggttctgaaaaaatgaatgttaaaaatccaattatccaagttttgtttgaaaataatcgtgccccagagtttgttcaaatcaattggttacatagtttgttgatcctcctaaaacgagagttcaatgtgatggaatataacggtgttggtcactctttaggtagcaacgatcttgtcaatgaagcgttaatgtatggggatgatttgcgggtgcctaaactaaaaaagttggtgaccattgctggaccctttaatgggcttcgtggtttcttgcatgccaaatcggttcctgcgttattaaagatggatcatcgtccctcgcatcaaaccagacattttaaacgaatgttgcagtatcgtgatcattttccaaaggacgttcaattattcaacgttgtgggcaaagtcgatggctacttggataacgattgtttcgtgtcagtgaactctgctcgatctgttaaatacttgttatacggagttttaaaggattatcgagaactcttaattacaggcgaagaaggatatcattgcagtttaaatcataatccaatggtttttaatgctctaaatgagtttttatgggatgattatgcgacattgcctaatatgcaaacccgtaatgtgccaatcagtgcttctgaattaaatgaaactaacgcactagcttcgaatgtgggataaacctgcacaagggctatttttttaagatttaatttagtttgctgatttgagccaaattatatgcttttttaatgaatggcgttcagaatggaagatgtgattaagtctatataggaggcaaataatggtagaaaaagtaaaaattggtaaaacggatgtgttgggaacaccacttggcttaggaaccaatgcggttggtggacataatttattccctaatttaaatgacgctgagggagttaaaattgttaaaacggctttgaataacggaatcaactttctagacacagcctatgcctatggattcggccgttcggaagagttaattggtcaggcaattcagggctatgatcgtaaaaaaatcgtgattgcaaccaaggccgcacaaacgccaggacatcccgatcaactagataattcacctgagtttttaaaacaggctgtcgaagatgcccttaaacgtttgaaaacaagttacattgatattttctatattcattttccagatggtaaaacaccgttaaacgaagcagttaaagccttagatgaaaaacgacaagaaggtaaaattaaagcgattgggatttcaaatgtgagccttgatcaggttaaagaagccaataaagacgggttagttgatattgtggaaaatcaatatagcttgattcatcgggatgcagaaaaagaattgatgccttatttgaaagctaataacatttcgtttgtaccgtttttcccattggcatctggtttattaactggaaagtattccagcgtagtttcatttgcttcggatgacattcggcatagtaacccggattttcgtggtgatcgttttgccaaaattatcaaacaagttcaaaaagtacaaccgattgctgataaatatcaggcaaccattgcccaaattgtgttagcatggtatattaaaaatccagacgtcacagtggttattccgggcgccaaacaggctaaacaggttgaggcaaacgcaggtgcgcaaaaagttaccctatccaaagaagaatatgatacaattaactcattgttcaaagacttataaaaagtaagtgcttgacaactaaagtttaaatttacgggaggaattattatggatgcacaagaacaacaattaacggatcaagaaatccttgatgcaattaaaactggtaagaagatgctattttttacggctggatggtgccctgactgtgcattcattaagccagtaatgcctgaaattgaagctgaatacgatcagtacgattggattacagtagatcgcgatgctaatatcaagattgcgcaaaaattcggcgttatgggaattccaagtttcatcgccttagacaatggtgaagaactcggccgttttgttaacggtgaccgcaaaactcgtcaagaagtcgaagcgtttgtggatagcatcggcaaataaataatcaaatcattaaagtgtaaacaggatcgactgtataattaatacagaggatcctgttttttaatattaaaatttaggggaggtaaggctttaaatgaatgtgacaacacagcttgacttaattttgcgggtattaattgctggcgcatgtggttttgcgattggctatgaacgtgatgcacgtgccaaaactgctgggttacgaacccacatcattattgctgtgggtgcagcgttgatgatgatcgtgtcaaagtatggtttcatggatgtccttggtaacaaaggatttgaattggatccttcacgaattgctgcacagatcgtgagtggaattgggtttattggtgccgggacaatcatcgtgaaacatgaagatgtgaacggcttgacaacggccactggcttatggacgacagctggaattggcatggcaattggagcgtgaatgtacgttgtgggaatcatttctgctttattagtgctagggacacaagtgatgttacatcgaaacttgagctggcttcgattgccaaataccaacgagataagattacaggtgaaacccggtgatcatcatatctccatcattcaaaagcgacttcaggccgaagatgttgaagtcacaagtatgcatgtacgaagaacggatgaagttacagttgttcatttagcagttcaatctgaaggaccgactgatatggagaaactaaccgcggtattggaaacaatgcctcaagttgtggatattgaaatttattaattgcatttgaaggaccaactatttccacaaaaattctgcaaccaacttatcaacgtttggattttcatggagggcactgtgctgagccacgaaacgattgcctgaaatggtgacgtggcgataactggcaacgtgatcggttacaacggctgccaacgctttgttgcttttaagtgggacggcagtatcagagtccgtgtggttcaaattgccaccaatattcaatatctggaggtttttaggaagattatcagcagcagttgctaaactattggttggggtgatatagccaaacggagtactaatggcgacaaactttttgatggtgggatattgactagtttgaacttgtttattttccaaataagctaacaccacgctaccacccattgaatgagcgatgaagtctacatttttgatgtgataaacagtttttagttccttcatgaaggccggtaaagtttgcatctgtttttgaggatttgtgtcgtcagtaaaagtcagctgaattaatggattttgtgttaaggaaccgacttttttaaaatgcgcttggccgttagaatcaatattgacctgtagagcagcgtgcgccagatttttgcgattaaggcgccgaatcatcccattaaaagtgtgttggccacccttatatcctggaattaagatagtggccgtgtctgattgggaaacgttcacgtgatttaaaggtgcctcacgatgattaatgtaaaaaagacagccggcaaaaacagcgacaagtaaaatgaaaacgcgaattaagatttttttcatgttaacgacctttcaagggcttttagttcaacataccacgcgaaaatgttagtgtgaatttatagaattgaaacgttacgtatatttaattaaacggaggtaatttcatgaaagtatttgtaattggggcccatggacaaattggaaaactattggtagcacagttgcttgatcggggagatgaagttgtggctggtattcgagatgccaaacaacgtgacttttttgaagatcaaggggcagcaactcagttgttcgatctaacagaacaacctgatgaaatggcaaaagttttgaaaggggttgatgccgtggtatttagcgcaggctcaggtggtaaaaccggagatgaccagacacttttaattgatttagatggggcagttaagagtatggaagccacacaaaaagctggaatcaaacggtttgtgattgttagtgccatgaatgccgaagatcgtacgctttggacagcaattaagccttactatgtggctaagcactacgcagatttgtatttgaaagacgagaccaatttggattataccatcatcaaaccgggtgttttaacaaatgaaactggcaagggcggagttcaacttaatcaacgtaagggccaaattgcacgtgaagatgtggctgaagtgattgttgcaacgttgcataatgatcaaacaattaagaaagagtttgcaattagcgagggaaaaacacctgtcagtgaggcagttagccaggtctaattctatgtataaaaattcatttgaaacatgttccatttaggacacataagccttttaatggaacatgttttttatttggggaataactttacagtaagacattttacagcttatactggatttgttgaaagcgcttcatgttagataatctttggccgaagatttattgattattatttattttattggtttttgtcgtaagcaattattatttgaggtgttttatgaatgattggattaacaacaaacttttgcccccaattatgaagtttgttaataccaaagcgatcacagccttaaagaatggtatgttagtcagtttgccatttattatggttggatcaatcttcttactgttaagtgcatttccatggccgccaattgctaattggatgaattcaacaggtttaactccttattggacgcaagcctataatgcttcattcggtgttttagcaattttcgctgtagtcggaattgcttataactgggtaaaagatgatggctttgaaccactaccagccgggatgacggctttggtaagtttcttcttagttatgcgtcctactacagctgttatgaatgctgctggtaaaacagttgtttcagctactcaagctcctacaatgttaacaggatttattgatcgtacttggcttggtggtcaaggaatgatcgctgctatcattattgggttattaactggttggatttattcttggtttatcaagaatcatattactatcaaattaccagatcaggttccaccagcagttgcagaatctttcgttgctttgattcctgcgtttgtcattattactggttggttaatcgtttatatcttatttgatgccacagcacatacaacaatgactcaatggatttaccaaactattcagaccccattacaagggatgacagattcatttggtggtgtccttatcatttcactattgattccatttttctggttctttggtgttcatggtgcggttattgtcagtggtattatgactccaattttaactgcaaacagtttatcaaatgctgcaattctcaaagcacatggggttgttaatgctgcaaatggtggccatgtctttgttcaatcattacttgatcaatttggtacggttactggttctggtatgacgattggattagttttctttatggcattttttgccaaatcagttcagatgaagagtattggtcgtttgtcatttctgccaggaatcttcaacattaacgaacctgttttgttcggtgttccggttgttatgaacccaattttacttctaccatttatgtttatgcctgcaatttcaatgggctccacatattggttaattaaattaggtgttattccatacttcactggtgttcaagttccatggaccactccaccaattatttctggtttactagttggtggctggaagatgatgatttggcaagcaattgtgttggtactttcgttcttcgtttactggccttttgctcacaaacaagatcaaatcttgtatggtcaagaacaggctgctgtagattcagaagctcataccaaagaagctgaagctgctgcaacaacagaacatgcaacagactaattagttaaacttaaaagtctatttatggcgatgaaaatcaaagtgaatagacttttttatgaaagtgaatgtaaacaaacaatttttagtaaaacgttttcaaagtgagttatacttgaattgtacgttattacaaaatgagaggagttcataaaacatgagtaaattaaaggatggttttctatggggcggtgcagttgccgctcatcaacttgaaggcggttggcaagaaggcggcaagggtgttagtgtcgcagatgtgatgacagcgggcgccaatggtgttccacgtgaaatcacggacggtgttttgccagggaaaaactatcctaatcatgaaggcattgatttttaccatcgttataaagaagatgtgaagctttttgctgaaatgggtttcaaatgtttccgaacatccattgcttggactagaatttttccaaatggtgatgaagataagcctaacgaagcaggactgagattttatgatgatttatttgatgaatgtcataaatatggtattgaaccagttatcacgttggctcattttgaaatgccatatcatctcattaaagaatacggtggttttgccaatcgtaaagtgattgatttctacacgaattttgcggaagtctgttttaagcgttacaagaacaaagttaaatattggatgacatttaatgaaatcgataatcaaagcgattttaacagtgaatttgcggtagcaacaaattctggaattctatttaataacgtgaagaaggaagaccgcgaagcaacaatgtaccaagcagctcactatgaattggtggctagcgctaaagctgttaagttgggtcatgaaattaatcccgatttcgaaattgggtgcatgattaatatgacgccaatttatccactgaatgcggatcctaagaatattatgttggcagagcgcatgatgcaacgccgctattggttctcagatgtgcatgcaaatgggatttatccaaataacgtggaaacttatttgcaacgtaaaggttatcgtcaagatattactgatgaggatcgcgaaattttgaaacagggtactgtggattatatcggtttaagttactacaattcgatgactgtgaaggcagatggcattgatttagatggcgatattaacccagaggaacctgtgacaaagaatacaacattggaaactagtgaatgggactggccaattgatccagtgggactgcgttattcattgaattggttgacggatcggtatcatttgccattgtttattgttgaaaatggtttgggtgcgcgtgataaggttgaggatgacggcagtattcacgatccatatcgagtggactacttgcgtgcgcatattgctgagatggaaaaagcggtagagctggatggtgtggatctgatgggttatacgccatggggttgtattgatttggtttcggcaggaacgggccaaatgtctaagcgttatggctttatctatgtggataaggatgatgatggtaagggaacgttgaatcgttcgaagaaggactcatttgactggtataagaaagtgattgctagtaatggggaagatctgagatagagtgttcaagagagcggtaacttctgagcattagcatagatagtcgaatgattcgggttaggaatcgtttgactatcgtagctaagcggaggaagttgctctctttaacacgttccagctataaaagttcaaagtaatcaaaatacgaacttaagcagtcgaaaatagcatctcggatccacaaaatcattctaagtactaaatcacaagatcgtttaaaaagggatctgaactataaacgggcgatcatctgcttgttttggctcgatcctttttcatacataaaaaataatacgagggagttaggaaaatgaaatattatattggtttagacattggtgggacaaccattaaatgtggattagtagatgaaacaggtaaaattattgaaaaagatagtgtcaaaacgagtattaaaggtgaagagattcttcaaaacgtcgaaacgattgtgagtcagtttaaatctgaaaagccaattacggccatcggggtgagtgcaccagggattgttcaaaaagatggattcatgacaacaggaggcgcaattaaggatttctttggaattaatttgaaagaggaaatcgaaaaacgtacggatatcaaaacgacggtggaaaacgatgcgaacgctgcggcatttgcggagcagtggaaaggtaatgcgattggatttcacaattactattgcatggttgtcggtaccggtattggcggtggtctaattattaacgatcagatctatcgcggcggccacggtatggctggcgaactaggaatgatgtcggttatgaatgtggataatgatcagcacctagaattgaatagtttgagttttaccggagcgacggtgtttggcctcttgaactactataatcatcatagcgataagccagaggttaccgatgctcgtgtaatttatgagctggctgataaaaaagataaacttgctttagaaagtttagacttcttctacacagcgctagcgaaaggaattattaacctaatggtggctttggatccagaaattgtactaattggtggtggtatttctgctaattcacaatttatggaaggtctccaagcgaagattgcagatttgaaatctcggaatagcgatgtacgtgatttgacctttgcggaagtgaaaccggccaaattacgaaatgatgctggcatcatcggtgccgtttaccgtgcaattcaggccaattaacaaaacgcctattacatgtatgagataaagagcttgaagcaacttaaattcgtgcttttaatggctgttttggtcaccgttaccccctagaaaactgataattgtgttaaaatgtatgtgtaaacatgacaagggggcccgatcgaatgaaattggatttttcagttgcggtacacagtttattttacttggaagcaaacagccctcgtaagattgctagccgagaattggccgcttctttagatctgaatgcggtggttattcgcaatattctatcagtcctccataaaagaggttatattgagggaacagtagggaaaaacggtggctatcagctgaaaaaagcgttagcagatattaacgttggtgagttatatgatgtcacaattccaccgactttaagctatgcccgttttattaccggcagatctgaaggaattaacaaaacagatcaaatttctagtaacatgtcagaaacgttgacggatctgtttacgttagcagatgaccagtatcgtgcattttatcatcgtttcacgttagcagatttaaaacaagatttgtatcatcatggctattttaaaaaattagtcaaaataaacgataagtgagatgagtttttctatggattattatgatcaacatgtacatacagatttttcatttgattcagatgaaaaaatggcggcgtacttgaaacttgcaggagataattttgtcagcacagaacatctagattttaaggatcctgatgacaaagatggtgatgacttatttgactatgatgcttattcacgcgagattcaccgtttggaagaagacacgggcaaacacatttttaaaggtgtggaaattggctattttgctggacgcgaaaaggatatcaaatcgtatttgaaaaaacatgactttgatattaagcttttgagtttccatcggggacctgattatgattttgatgacagcatggtttcgcagatggatccattgaaggttgctgaccagtattatcgtttgatgtggaaaggaattaatgcgttccatgatgctgatgtcttagctcattttgactatggtgtacgccaacttaatttaacttcaggaatgtttgaaacaacggccggagtgttgttggctaacattttaaaactcgctgtacgttataatatggcctttgagttgaacaccactagcatgtataagtaccataacatcggtttatatgactatgcccttgaaatttataaacaacttggtggcaaacggtttaccattggctccgatgcgcatgatactacgcagtatatgcggaattacgaaaatgcagttgatatgctgaaggctcatgacattcatcacgtcaatgtctatcgtaagaatgccatgattatcgtgcctttggatgatgtggatgaaggcattaagtactaaaattaaatgttttttaaataaataagggacggaaaatctaattttgattttctgtcccttatttatcgatttttgtgtttttgtgagtttttttacgacaaaatgaggaatgtaacattttaccttcttcatgtaacgctttgccttcttatatttttatcacctttctcttaagtttgtgagagaaaggtggtttttttaatgaaaagaatatttttaggatttttggtaatgtttgagttgatgggggttaataatgtgtcagcaagttctatttataaagtagcccatacaactagaggatcttggcatgccagttatgaggttgttgtaagtcatagttatgaggttgttgtaagtcatagtcaaattaaatcggtgaaaaaggtgaaatatcgtgccatttattgacataggagcacttgaagaaaagctacgtaaattgcgtgatgctggtaaaaccattttaattgctagccatgatcgaatggtgattcagagcgtggccgatcatgtttatcatgtgaatgaaggtgaagtcactgcgtaaaattaaagtaagaatgtgtaaataactagtaagatttacggaagagcagttaaatgtgggtccattatttttgtattgtgcgctgccataatagaaatctactgccctttagtattgtggctgctgcataattaaggtttggaacaatttttgttgtgctcttaaaaaatggtgatattattgttatactggataacgtacaaaaacaagaatagggagatctagaaaatgaatgtcgatgctttagttaaaaagtacccagaagtaaaaaccatgcaagatttgaagccatttttctggcgaaatccagattacggtaaagaggccaaactctcaatcggaatcgaagatatttttgatgccgaagcacgattccatcgttttgcaccttactttgaagtcgcttttccagaaacagttgccactcatggtattcttgaatctccattagttgatcttcctgacatgaaagcccgtttaaataaaacttttgctcacaaaattgaaggcggcttgtacttaaaagctgataattacttgccaatctctggctccattaagtcacggggcggcatttatgaagtattgaagtttgctgaaaagattgctgttcgcgaaggcggattaatttatgaagataattatgctgttctagctagcaagaagtatcacgatttgtttgctaaatatggaattgcggttggttcgacaggtaatttaggtctttcaatcggaattgtggctcaaaagcttggttttcggacttctgtgcatatgtcagcagatgcttcacaatggaagaaagacaaactgcgggcctttggtgtaaatgttgtggagtacaatgataactttacccatgcaatcacggaagcacgtaaaatggcagctgaagatccgatgacttacttcattgatgatgaaggctcatatgatttgttcttgggttactctgtggcggctttacgtttacaagctcagttaaaatcacaaggaatcaaggttgataaagatcatcctttgtttgtatacttgccagctggtgttggtggtagtccaagtggtgtaacctttggattaaagaaggtcctaggcgaacatgtgcatgcaatttttgcggaaccgacgcatattccatctgttactttaggaatggtgaccggtttaaacgacaaaatttctgtctatgatattggcattgatggaaccacaaaggctgatggtttggctgtgggtcgcgcatcaagaattgctggtaaaaatatgcgaacgttattgttgggaaccgcaacgtttaatgatagcgatatgatggaagatgttgttcgtttatacgagaccgagaaaattggtttggagccatctgccgcagctggtttcacaattatggaccaagcattaggaaatctagctgcagacttttcattgaaaactgctaatcatattgtctgggcaactggtggtagcatggttcctcaagaagatatggaccactatcttgaagttggtcgtgaagaattagctaaatagtgtagattaaggatcggtggaagctggtccttttttgtgcaacgaagagattaattatttgaagcatacttatagctgcatactaatggcaagttaataaattgttggcaggagcatctgcacttgtggctgtaagggcactgattgtagtgatttacttagtataagaaaagttggttttccagcacgttttgaagttcagaattaacttcagaacgtgtttttattatggcttattatttgcccgcgttatactgaaagagagaataacggaaagaagaggcggtttaaatggcaattcagcataaagaaacaatacctgataacatcgaggtgatgggcgcacatgttaacaatttaaagaatctcaatgtgacgattcccttaaacgcatttgtagcaattacgggcaaatctggatccggaaaatcttcgttggcaatgggggtcctttatgctgaaggtgctcgccgatacttgaattctttatcgacatacacccgccgtcgcattagccaagttgggaaggctaacgtggatgaagtaaagtatctaccctctgctctggcactgcgtcaacggccgacggtgcctggtgtgcgttcgacagttggtaccatgactgagagtttaaacgttttacgactgatgttttcccgtctgggttcacatgtctgtccgaatgggcatcgggtaccgccaacactagaggttgccgaaaacatggggtacgtggtttgcccaacttgtggcgtgaaattcatggcgcccggtgcagaaagctttgcctttaattcggaaggtgcttgtcccacatgtaatggaattggcaaggttcgtcagattgtgaaggagcgactcattcctgatcaaacgaaaactctacgggaaggcgcggttgcgtcatggcgattacccggacgaaacttcatgatttatgtagcggaacaaattggcatcccgattgatattccgtttaatcagatgagtgctaaagatcaagagcaagtttggcatggtgaaaataaaaagtatgcgattaatattccttctaaaacaggtaaaattttccatatggataatgctcaatttgaaaatgcttatgcagccgttgaggatagtttagcgaccactaccaatgaacgagcaatcacgcgtttgaaccggttctactcatttgatacctgccctacttgtcatggcagccgatttgatcccaaactattaaaaactaaattagccgataaaaatattgctgaagtttcaaaaatgactgtaactgaattaacccaatttatgcctaaaattgggccttggttgccaaaacaagtgcaagaattaggagccagtttagttggtgaattgaaagatagtttgcaaccggttcttgatttaggcttagactatttaactcttgatcgagctggtgatacgttatcaactggtgagttacaacgaattcagttgggaagaacgctgcgaagtcaaacaacgggcgtcttatatgtattagatgaaccctcggttgggttacatcccgctaatgtcagcggcctgattaaaattttgcatcagttagttgcgcaaggcaattcattggtcgtggttgatcatgatacacgcattatttcggctgcagactatgtgattgaaattggaccgggtgctggtaaaaatggcggaacagtcattgatcaaggaacggttccgacaattcaaaaaagttcgaaatccttgatcgcgccgtttttaaatggcactgcaaagctgttggttcgcaaacaaattcctaaggcacaattatttgctaaaggtgacattgcggttggagtttcggatcgctataacttgcatgacgttacagcccattttccgaaaggacgtctcagcgtggtttctggttattctggtgccggaaaaacgactttgattttagatagtttgattccagccattaaggcggccattaaaaaagagccaattccaagtcatgtcagccatttggatcgtgcacatattcaccgggttgtgatggtagattctgtgccagtcgggaaaaatgtgcgatcgacagtggccacttactctggaattttggacaccttgcgagttttatttgccgacacagaagcggccaaacagcaaaagtggacagctagccatttttcatacaacgtgggatctggagcctgtcctaactgtaaaggaactggaacaatttcgcttgatattcagtatttgccggatatggtggaaacgtgtcctgtttgtcacgggaaacgttacaatgatgagacattagctgtcaaatggcatggctattcaattgctgatattttggcattggatgttgagcacgcgttaccagtatttgccgatgttccggccatcaaaacgattcttgaaaagctggctgaaatgggattaggatatttagttctcggcgaaagtactccgatcttatccggtggggaagcccaacggttgaagcttgtttcacaaatggggcgtaaacaaagcggcacgttatttgtgtttgatgaaccttccgtagggctacatcccctggatattcaaaccttaattcacgtatttgatcgcctgatcgaacaaggagctaccattattatcattgaacatgatttggacgttattgctaatgcggattatgtggttgatctcggccccaagggcggtcaattcgggggtcaaattattgccgcaggaactccccaagaagtggctaacacagctaaaagcgagactggcaagtatttgaaagctcattttgacttgtttcagtaaatgatggttagcgtttcattagagtggcaataatttctagcttatgaaagttataactatactggctatttttttaaaaacatgctatgctgttagaagatgaagaaaaggctttcatatctaatattattactggaggaatgacctatgcgaattaaccaaaatgatttatatgatttagtgcgttcagaggacggaccatttatcacgatgattttgaataatccggccgatttaaaagaagtgcaacaaacaaaaatcacttttaagaacttaataaaagaagcaagagaaaagtttaataaacaatttgctgatgttgattgtgatgcctgtttgagtcgttggggaatttatggcgatgacagcagtttctggctaaacgctaagggtcgctcaacagtattaattggtaatatggaccggattgaaactttccaattggcagaggcatatacgaatcaggtttctgtttcgcgtaaaccaaatgttttaccaattattcaagaacttgaaatgaaattcgaatacttattagtgacgcttaatcaaacttcatttgagctttatcgtggtgaaggctatgatttgcagaaagttcgtttggatgaggatgcaccgagaactttaaaggaagcattggggacaatgaattagttggtggtgaggtcacattccgtggtgcttcgaatcatggcggcgatgtggcagtagcttatcacggtcacaatgagaagagtcaagaaattacaaatgatcaaattaactattaccaaatggtagatcagtatgttacagaaacttatgcgcaaccagaaggcttgatgacaattgtttttgctttaccagagaatcaggcacgtttccgacaagtttcaaaaaatcaaaacttatcgaagcatttacgaattgaggaatcgccaagtggcttgggattggatcaattagaggacaaaatgcgtccggtggcacataagtggtttgaagagattatggatgtgcaaaaacagcgttatgaaacggcgaaggataagaataaggcgacgagtgatatgcgtgagttggtaagatgcgcggtggctggccagattgatacgttgtttgtgagaaatgatacaacggtgataggtagaattgatgaagagggcaagctggatacggatacgccggaagctcaaagtaataatttgattacggatattgtggataagacgatgcagagtgcaggccgtgtggttctgttggatgcggaagatatgccaacggataaggtggctgcgggaatattgagatattaagaagagtaaaaaagtgagcgagacataacggtaagcgtaaagaaataagcgtgctggatgcggggagaattccccgctggaagcatgcttatttcttcgtttttagtgtgcagattattgttggtacgcacgtcctttgatcgttgttcgatagtacgtttggcgactgttttgactttgtggggtgcgaaaccccaccgttttggaaacgatatacagtggccgtttacgtgatgcctcaaagactcgataaaggtaagcgcccaacatcccaatggtcaatagagtgatgccgaccattaagaatagcgcaaagaccgcaaagtgaatggtatccatcgtggtaaacagcgaggtaaccaagtagccaacactaaatacgattgacaaggttcccagccagttggccaactggaggggaaatgatgaaaacgaggtcacgccatccattgccaaacgaatcattttgcgcaacgggtatttagaagtcccggcaattcgctcttgacgctcgtaagtgacgtcggtctgcttgaaaccgacccagctgaccatgccgcggacaaagggatcggcctcgttcatttgtcgcaattggtagaccacttgcttgtccattaaccgaaagtcaccggtatccagcggaatattgacgttggtgattcgttttaaacctctgtaaaagagggccgccgttgcctttttgaaaatactttcgccatctcttgaaagccgcttgccatataccacatcgtagccttcatgccatttatcgatcatatccacaatgacggcgggtggatcctggagatccgcatccattaccacgacggcctcgccttgggtataacgaatgccggcagtaatcgcgagttggtggccaaagtttcgtgaaaattcaaccaaccgaatattgttgtgcttggcttgctgattggaaatcagttcgacacttctatcggtggagccatcatcaacgaaaatgaattcaaaggtctgcggttgattggcagcaaagttttccaaggtgttgatggtggtttcaatgccttgctcttcattgtaaaccggtaggacgattgaaattaattcctgttttttgtccattaaatgacctcctatttataaattgacgacaagtcatacagcacgccggatgaacccattccgccaggaccttgcatggttgtctgtttctgggtagacttactgttcgattgaccagctttttgagtggattttagtttgggattgctcttcgttgaaggcttggctcccggcttaccagttggctttttcttgcctgacggagctcctgctggtgcctgtttgctgttaggtgctttagcttgtttggtggacttggtggtcgtcgtagctcctgggccacccatgccggcttgagaaccgttgctgcttgaagattgatacaagctggttttgactttggtagcgtgtttcttaatccaattgataatcttggtattccccgatctgccggagtaatagaagtacttcaagtcaccgtttttgacgagtttcttgaattgagacaaggtaattgccggatcagttccgttaaagccacccatcgccatgaccgccttcccggttttgatgatgtaaggcgctgcggttgtcgaatcactggtggcaaacagatatttggcgtttccttgatgcttttcaacataattgagcagtttggtgttgactgagctgttgcccatgccgccaccgccgcccggcatgccgttgctgctggatgtgagcagcgatggtccggcggttggaatcatggctgattcagcggcaatcgtgggcgttaacgaccaccaggttggagctgccatgatggaaatgagaccgccaaccaacagcgcttggaatgcgcgaccccgtggtaaaacagccatcccaactgaaaagccgattgcggcaattagaatcacccaggtgagccatggatagtaactgtaaacgtaccaggattgaagcgccgcagttgccacgattgcaatcgggagcagatagaatttccagctggttcgtaaactgtttttaaacaggccgaccagcgcagtgacgccagttccaaatagtgctgcgattggtggggccaacatgatcatgtagtagggatgaaagaaactggcaacgctgaagaaaccgtagaccggaatcagccagctggtccacaggatcaactgtttttgttgcttggacaggctaaaccaacgtttgcgacggtctctaaagaagactaagccgccaattaagccaaagagggcaaatggtaataaccaactgacttcaggcccgagggctgattggaagagtctaaacggtccggcagtgccaatgttgaaggcgccaccgccaccaccgccgttacccatcttgccggggccacctttgccgccgtttggctggcccttcatttgcttaccgccgggtggggtttggtgtttgccggtttgcttcatgccggtaggggcttgaccacccggcattccaccaccttttttgttggtcgttttgctgttcattccggcaccaaatgtcccgccggttccagtggtttgaccaagcagtcgttcacttccgttataaccaaaggccagttccaacaaggagttggtttctgaaccaccgacgtaaggtcggctgctggcaggggtcatgtcgacagaaattgggtaggccagggtgaagactaagagcgacacggtggccaacgttaatttggtgattttctttttccaggtttcgttggctgccaaccagtaaaataaatacatggctggcaggatcatgaacgcttggagcattttgacgttaaaagcaattccaattaacgcaaagctgatcaacagtgaccaaattttgcggctgccaatggccttttcaagaaagtaaagggccaacattaagaagaaaactaacgtggcatccatgttattggttcgagaatcagccacgacgatcggtgtcagggttaatgccaaggcgctcagacgagctgcgttttgaccaaagtacggctggatcaatcggtacattagatagaccgatctgactccgaaaagaaccgatggtaagacgatgctccagccgtgcagaccaaagattttggcactgattgccatgaaccaaagtgcgactggcggtttatcaaccgtgatgtaaccggccggatcaaaactgccgtaccaaaagttgtggaaactttcggtcatacttttaatggccgcggtgtaaaaggcgtttgcagaacccgccttccagatttgccagccgtagaggaataacgcaaggacgaggattacgcctaaaatccagtcaaacctgaatttgcgttgataacgattttgggtattttcaatagatagattattggttgccatagtggcggacctcctttaagtgatgttggttgaatacccaaaactttgaaagcaaaaaattggtgggtacggtgatcatcaaactgacgataggaattagtcggctgtcaagaatcggccaaccgctggcaaaatgagcgaacaaaacactgatcagccaggtgaaaatgtaagtggcgtagtatttccatgcaaccgttttaactgaagcacctgtctgaaacacccagcggttatttaacgctaaccccagcagagaggtaatgccgtaaccgattgccatggcaatggttgcgttggttggatgaagtaataacagatagatgacataggtcagcacggtattaatgaatccggtaatcccaaattttaataattgctttgtactagtaatggatgactcactcctttctgaattgatgaaatgagtttatatgtttaaccataaaacaagcttaaaacatttgatttatgataaattgtgaataaccgagttgacggaatgcgtaaaaacctttaatttagtgtcaacgacaaaaggagaacattcaaatgaaagacttacacatattaataattgaagatgatgaggacctggcgaagagtctgcagctgtttttgggcgaaattgcgcaaacgaccgtctcccacgatggctttgaaggccagatgctggggcaggagggaatctacgatctggttgtattggatttgatgctccctcaagtcagcggctacgacattttgaaacactggcggaccgaggaccatttgagcatgccggtgctgatcttgaccgccaaagacaccctggacgacaaagtgcacgggtttgaactgggagccgatgattatttgaccaagccctttcaccgtgaggaattgctgatgcgggtgaaggcccttttgaagcgaagtggccaccttggtgacgacaataccctgtcagttgggccatttaaagtgaacttaagcaatcggattgtggaagttaacggcaaagagttggcactgaatggaaaagagtttgacctgctggtctacttcattcaaaatccggataccattattaccaaggaccagatttttgatcggctctgggggtttgagtctgaaaccgcgatttctgtcgttgaagtctatatgagtaatttgcgaaagaaaatcaagcagagctcatcgctccagccgatcaagaccttaagaaacgttggctatatgtttgaaacggaggaatcagattgaaaaaaggtgatccgcagcaaaaacaacagctgagccttttcctaaaggaattggtcgggttcgcactgttgtttgctgtacttggtttagttgttttcttcttatttcaccaatcgatttataaaaatatcgaccagggattggtcacgcaaaagcaaaacgtgttaagtaaccgcaaggcccctcaatttcggacgggcggcaatgcgcaaaatccagccccggccaagcccaataatggtgacacaccatttagaaccaacattttagtttttaacaaaaaagggcagattatcaatgctcaaatgctgggcaatcggatttacaatctatttatcaataccgaactggataagtcgcaagtcaacaaggtccgcgaagtaaccttaatgtcgaccgacaacaccttacattatttccgaaccctgttgattaaggtgcccaagtccaattccaatccaatttatgccggtaactatgttttgattttggaaaatattgataccgatttgatggcggttaacagttttaagcgctcactgctgacaacgctggtcttcttttggatcgtcgccattgcgattgcttatttcctatcccgatcgagtatgaaaccgatcctggacgcctggaaacgccaacggcaatttagtgctaacgccgcccatgagctgcggacgccgctgaccgtcatccaaaatcaaatggagtatatgttaaccaaacccaagaccaaggtcatcgaccaggtcgatccaatctcaacttctttggatgaggtcaggcacctgcaaacgttgaccaaccggctgttgatgttggcccgttcagattctgggacaattgaaatcaacaaacaggaagtggatttgaaaccttggttcagccaaattctcaaaccatacgacgatatcgccgccagccaacataaatcgatggtgacggtccttaaagccgatggtaagggacgcttggataaggatttgattcgccagctcttaatcattttgttggataacgcgatcaaatacacgcctgccggtgggacagtcactgtgatgacggcattgaaccgtgatcgattgacgattgaagtgcgcgataccggaaccggaattcccgatgctgacaagaaacgaatttttgaacgcttctatcgttccgacaaatcaagaaattccaagactggtggtaatggcttgggattggcgattgccaaatggattgttcaacagcactcggggaccatttctgttaaggacaattatccaaagggaaccgtgtttgatgttttgatcaagctgtaaaatgataaagtgattactgtgcacaaagaaagctcggagtaaaagtgatttgacttttacctcgagcttttttgtgattgggttccactagatcaatgattgatcctgcttatcggccttgttaattcctggaaataattcgtgcagatattcaagcggttcaactttaccgactttgtcagtgtatacaacttgagtcacgttgtcataggttaaggtgatcagtgactcaccgtcttcatctttgaccacataataacgaataccgagttggatggcgtaaaagatcaaccgttgggcatcaaatgagattttcccaattgatggcagaagggtcgttgcgcccaaacgttgggcccgccagcgcttggcgaccgtggttccgaagtccatcaagctaccatttttgatgtgttttaacaacattgccgaagctgtcagttccgggtgggtaaccacttcactgaagtcgtccagtgcctggagctgttcggaatgggcatgaagtgacttggccatctcaatcaactgatcaaagatttggatgccttcagccattttgaaagtcggctggttggggttctccaacgccacctgattgttatcagtgaaagattgttttaaatcagcggcaatattttcatggtcaactggggtgactaagagatacattaagaagaattttaaaaagtacattgcgtgacgactgatgccattaggggtaaacggcgtgttatccagtactcggaattccagataagagatgcctttagtgcgataatctttaatgtcgtcttggccgcgaagtcggaccggtccataaaattcagctgtggaatatagataatggtcgtcgattgcatgattaatgccgtcaatgtaatgatccaagctggtataaatggtggcgtcaacctgatcttgtggttcgttgacatagccataaatgctgttgcggatacttctgaccggatgggtgagttgtttttgatcctcagcggataaaaagcctttctccgcaattgggctggcaccaaacaaataagtcagcagccaacggtgaaggacaaaattttgagctagctggaagtacaatgcatttttgaaggccaccaaggtactgaactggtcttggtagtggacatacagccgattgatgaccggttcggggatgctgaagttgacgtgaacgccagtaatgatttttctggcgaccccgtacttttcggttaagtaatcacgatatttggcgtaggcgggccgaccaaaatggcctttgataaagtcgacgtcgtcttcgtccattgctggcggcatactcagcggccaaaaggattctgatttatcaatcgaccgatataaaactgtctgcaaagtatccaattgatccaacacgccgccaatattggggttgggatcggtaataatttcgctcattgattcggaaaaatctgattgcaaatagggatgataacgtctggaaccgagattttgcggatatggcttgcggcttaatcggccgtggtcatcgattcggtgttcttcgatttcaatgccgattaggctatggtaaagctgttctgcaacgcgttcttcttgaatgtgttttaataaatttttcagcatagtagtcccccagccggatttagttatacataattataaacaaaaatcggcagaatggtagccatacggccgttctgatgaaaacgtaaggttatttttaacttcttgaaaatcattgccatcggtttcgtatttaacccatagaaggtgatgaaatgctgatagcgatgattaataatcaattagtgaatgcggctgaattcaagggccaaaagaatttagccaatcgactggtttgcccgggatgcaggcaaacagtgatattcaagcgcggcaagtaccgcattccccattttagccataaatctaatcggatttgcggtagtttcagtgagaatgaaagtcaggcccacctccaaggtaagctgacttttcaacggcagctgcgagccatggcgacagaggcggtgttggaatattatctgccaacaattgagcagcgggcagacgtttatttaccgtctccaaagctgattttagaatatcaatgcagtcccatttcatttgccgaactttctcggcggacggcgaattaccagtcacttggaattgacgtggtttgggtgctgggagatcgccatttaaatgccgccaaacgattggatggtgttgccaagtttgctcgttttagcacccaactgggcttttacatcatcttttattctgctaaaaatcagcagttccgaattgattttcagattcgcgaagttgccggtaaactcactagtcatatgcgactatttaaaactttagccgagttgaagcgattcattgaccacccgccttcagctcttcaacagtattcagttcgagctactaactcggcaattttgcaccagcttaaccggattcagcggagtattgttttgaaaaatcccacttacctggacatggtcacgcgctgttatcaacgaagaaaagtctttgtcggctgccctttgatttgtcatggaaaagagggtgagggatggccgatctttcggcggactgctttgtgttggcgagtgtggattgttttgcagctgtttacgagcagtaatcgggaaatttccaatcaggagttaaatcaggttttcaaacaatcggttcaactttttggccaacaatttgcccaagtagacgattacgtccgtttctttcaaatggcctttaccagttttatctttagcctccgggccggcggctatcttcgacacacagtagccggcgtgcaaatcattaaacaaccggtgtggtttgccgattatgatgaaaaacggcaatatatcatgaccgccaagccggaggtgtgctaatctattggtaactaactatttgaaggaggacgttatgccaaaaccacaagaattaccgcttagaaaagatgttccagaagaaatgacttgggatctgacgacgatttatccaaccgatcaggaatttgaaactgactatgaagctgttcaaaccggtgccaaacaattcgctgaattagccggaaccattgagaagagcgcggccgcgctgctgacggcaactgagcgtttgatgaccttaagccgaaagcttgaaaaagtctatgtctacgcccagttgaaaaatgaccaggataccagcgaagacaagtatcaggccatgtattcccgtgcggaatccttgggggctcagtttggagcggcgactgcctggtttgaaccggaactcctcaaagtttctgacgatcaaatcaagcagttttatcaggatcaacccaaactggccgattatcgacggtttttcgatcaaacctttaaacgccgtaatcatattttaagcaatgatgttgaagccgtcctggcgggggccggcgatattttctcgtctggagagaaaacctttggcattttggataacactgatctttcattcccagcagtgactgatgagaatggcaatcaggtgaagttatctcaaggtgtttatggtattttattggaatcgacaaagcaaagtgtgcgtaaagaagcgtttgaaaaattgtatcaagtttatcgtcagttccagcacacgctggcggcaacactgaccactaatgtcaagaatcacaatttcaaagccaacatccgccactataacaatgctttggaggccgctttggctgataacgaggtgccgacagacgtttataataacctgatcaaagtggtcaacgagcacctcgacctgctgcacaggtacgttgctttgcgtaaaaagattctgggccttgatgaactgcatatgtacgatatgtatacgtccctagttggtaaaaaatcacccaagtatacgtttgaacagtccaagcaaatcgctttggaagctttgcaggtaatggggccggattatgtcagccacgttaaagaggagttcaacaaccgttggattgacgttgttgaaaatcaattcaaaagaagcggcggctattcctcagggacttacgataccaatccgtatattttactgaattggaaggataatttggataatctctacacgttgatccacgaaaccggtcatagtatgcacagctactattcccatcataaccagccttatcagtatggtgattactccatttttgtcgctgaaattgcgtccacgaccaacgagaacatcttgacggattatctcttgaataaatttaaagatgatgatgaaatgaagaaatttattttaaattactatctggatggatttaagggaacggttttccgccaaactcagtttgctgaatttgaacaatacattcatgaacaggatgcaaaaggtcaaccattaaccgccaactttatggatgattactatcgcaatttaaatcaaaaatactatggtgatgccgtgatttctgaccctcagattggccttgaatggtcacggattccacatttctattacaacttctacgtttatcaatattccaccggctttgctgccgcatcgacattggctgatggcattgtgaacggcggccaggccaacgttgataaatatttgaactacctcaaatcaggcagttcggacacgccaaccaacgtcatgaaaaaagccggcgttgacatgacgcaaccggaatatcttgagaaggccttccagatttttgagcagcgtctggatgaatttgagcgtttgtacaacaaatagtttcgctaataaataagcgtaaaaaataccgacatttgggaaatcccagatgccggtatttttatggattaaattagttgaatcgcaagtttgatttgggatacggaactgtcgttggtttctttgaagcctgctcgaagtgagcggccgatcccagactcttggcacaaaagccaaagagagaattgtaatcaaagtccttgatacgaatgccactgtcagcaacgtcggaattaaacaaaacggtggttgatggatcgcggacttccatttcgtggactactcgctgatcacaacgaaacattttttctgccaaatcagagcggcggtctgccatgaacatctcgacatccaaaccatttcgttctgcgagcttggcaaccagttcatctgagtatggtactgaattaatcagaagttctttttgcaggtccatcaagaagcgtcggccaaacttctttccctgaaatgaagctgccttgaaatccaaaatggtatcgtagggcaggttgtgatcaagatggctgagttgctcgttttttgaaaagtcgtgcaggattttgatgttgagcatcgaaacaaagcgcacgctgatttgtttgtttaatttttgtgaaatccgttcaatcgttttttcggcgtcgtaacaatgtcgattaagtggatcaacgaataaataaatctcaagtaccattattgcccctccatgtgtaaccgacaacaaaattaatatactaattattttctccattaagaataccaaattttcacgtaaaaacaacaattttgcttgaagtgtgtatgattgattgggaaaggttgttgaatatggtaaaattaagtctgattgaattttaccttgaagcaatagagcgttcgtttgagcgcaacagattggaagtgttagcttggttgagaattgggatgactttttagttccttacaaacaagctgttgatgaattaaaagtaaaattacgtggcatcagagcgcaattcttaaaaattgatggtcgcagtccgattgaatttgtgaccggtcgggtgaaacccgtcgacagtattaaagaaaaaatggttagaagacacatttccgaagatcggcttgaagaagatatggaagatattgccggtttgcggatcatgtgtcagttcgttgaagatatttatcaagttgtggatttgcttcgcaaacggactgatattaatattcttgaagaacgggattatgttcataacaagaaaccgagtggatacagatcataccacattatttttgaatatcctgttcagatgcttgacggcgaaaaagtcattttggccgaaattcaagtgagaactttggcgatgaacttttgggccaccgttgaacactcattaaactacaagtatcaaggcgaatttccagatgatttgaaaggccgactggaacgatctgccgaagccgcctttcatttggatgaagaaatgtcagaaattcgtgatgaactccaagaaaccaacaagcatgagccaggcaaagatgtaaggaagtcgtctgatgaagatagccatctacagtaatcttggtgagtcgtcaaacattgtggcgacttcattaaagaaaaaaattgaagaatcacccgatttaagcatcgacggactgaatcctgaaattgtcatttctgtcggtggtgatgggacactgctgtctgcatttcaccactatcaagacattagtgatcgaattcgattggttgggattcatactggccatttaggcttttataccgactggcgggattacgaagtcgccgaactggtggacagcttggaacatgacaatggtcaaagtgtcacgtatccactgctggatatccgggttaattatgtgagtggcggcccagctgattatggcttggcgcttaacgaatcgactctcaaacagattagcggttcgatggtggctgacgtctacattaaggacacactctttgaaagttttcggggtgacggtctttgtgtctcaacgccgagtggttcgacggcctacaacaaatcagttggtggcgcaatcattaatccaaccctcaatgccattcaaatggccgaaatctcctcgattaataaccgggtctttcgaacgctgggctcaccgttgatcatttctccagatgagtgggtgaaaattgtcccgaagagttccaaccggacgattttgacttgcgatcaccaaatcatctccaacgaagccgttgaatcggtcgaataccggatttctaaacgccggattgcttttgcccagtatcggcacacgcagttttggcggcgggtaagcaactcgtttattggtaaggttaatttagatgactgaatttacgtggaaatatacaggccaggccccgatcaaggtccggacatttattatgagttacgggatcacccggacattgttgaaaaaaattaaatatcatggtggaaagactttggtgaacggtgaagcctcactggttaaccgaatgcttcaaaccggcgatacggtcaaagtcgtcctgccgcctgaaccggaaaacgatcatgtcggtgtctccaacgttccaattgaaattgttcatgaagatcccaattttttggtggtgaataagccgtacggggtggcttctgttccggcacacaaccatgttgattcattggttaatcgggtaaaaggctactatcagcgccagggctatgccaatcaaaaaatccacattgtgactcgactggataaggacaccagtggtttggtgatttttgccaaacaccactttgctcattcagttcttgataagcagttgaaggaccggacaattcaaaagacgtacctggcgattgtcgctggtcgcatttcaatgcctcactttgaaatttatctgccaattggcagagccgatgattcgttcgtcaaacgccaagtggttgattccggcaagatgtcggtgaccgaagcttggacagtgcgtcgattagccaaacagactttgttaaaagttcgactgcacaccggtcggacccatcagattcgggtgcatatggctgccattggtcatccgttgattggcgattggctttacaattcagatgaccattcaatgaccaggcaggcacttcactgtgccgagttgactttttatgatccatttgccggtcgcctgcttcattgcgaagcgcggttgccggaagatatgcagtcctacattaatttgcataaactttaattgacgattaaccaatctgtttcccacaaaacgtgtttgagaattttggccaggaagcttttttggttggctgctgtgatataatgaactgcgtttgtggaggattttaagtgaaaaagattgattttggccaaaaatttgtgaagcagaatttacagttattccgttgtcccgtctgtcaaacaccattcgatgaggtggtgggatatagcttaagctgtccccatcatcatacttttgacatctctaaaaaagggacgctgtttttcctcaccaaacaggcaaataacgaatatgacaaatcgatgcttcaggcacgccacaagattttacaggctggccttttcgacccgattgtcgatgcgatcgcaacgtatttgggcccggaaccggaaaccattttggatgtgggctgtggtgagggcacgccgctggcacgattgctggcgcttcgagatggccaagataccgcaatcggctttgatatttccaaggatgggattaatttagcgacacaacagccagtcgatgcttttttctgtgtcgcggatttggctcggctgccgtttaatgaccacacaatttcgaccataattgatttgttttcgccatctgcctatgatgaatttaatcgggtagccaagactggcggccgattgattaagattattcccaacagcgactacctgcatgaattacgggtcgctttatttggcactgggcaaaagaacagttcttattcaaatgacaaagtatttgatctgttcatgactcactatcccagtgcaagcattgataagcttacatacgaattttcaattcccaaagggatgcagcaggaccttttgacgatgacgccgcttcactggggcaagggacggcaagataacgcccttcaactggttaatgcactcaagacgattaccgttgatgtttctgtgatggtcgcagatttttagaatatttggaggaaacaatgactaatcatatcgtactatttgaacccttaatgccggcaaataccggtaacattgcccggacctgtgccggaaccgacacggtccttgacttgattgaaccgcttggattcagcattgatgataagcacctcaagcgggccggactcgattattgggataaggtccagatcaattatcatcaaaacctgcctgaatttttgaagtcggtcaagaatccccaaaacctattcttagtttctaaatttgccaaccaggattacactgatccggattattctgacccaagtcaagattactatcttttatttggtaaggagacgaccgggttaccggaaccatttatgcgtcaaaatcctgaaaaggcgattcgaattccgcaggatgacgacaacattcgggcactgaacctgtccaacacttgcgccattgtgatctatgaagtactgagacaacagaacttcaacaatttggaacgaacgcatcaatatgaacatgataagctgaaataatcaacagccattctatgggaaggggggaacagcatgaaaaccaagcgaaccaagcaaaccagtagcaagccggttaaaaaacgcggccgtccacgaaagacgaccaagaagactggcggccagtcgagctttcttcagaaatatacggttaatgtcatcggtggtgtcgttgccattttggccttactgggattatttcaagccggaattgtcggtaccttaatgatcaatattgccaaactgtttgtcggcagtctttatccggtctttcttttggttggaatcgttgtcggcattttcctcgcaggcttttcccggttccccaaaattccagccaagtatacttggggaacggtcctgattttgctgggcgttcttctttggctgaccttaattgaatacattcaggctgcccagccggttgactttatcaattttaactggcagaagctggttgatgatgttgtttcttctaacagtgattccaacattggtggcggcattctggcaacgattgggttttatcttgcccacgtactatttggcaaaatcggcaccggaatcgtcgccagcctgatcattttgatcggtggttttattctatttgatatttcatttgcaaaaatttttacgggtctgcggacttgtttgacatttatcaagactcgggctgcagctatccgacagcagacggaccagaaacggtctaagaagtcggctaggcagccttcaccgacaacggctgccaatcatccacaaactgtggaacagcctcaaaatgatgattctgagccaaataagttgtcggcgtcagcgatcacgatttctgggatgccagtgagtgatgaagctaagcagtcatctaaaactgtctctaagccgacacctcttcaagaatccgaaaaagcggacgattctgccgacgttaacctcgtcgatgtcaaagaagatgatgcctacaagttgccgacaaccgacctgctgacgcaaatccctcaggatgatcagtcaagcgagttgcagtcaattgaccataacgctcaagttcttcaaaagacgttggacagttttggggttaaagccgaaattaagcacgtcagtttaggcccgtcggtcaccaaatatgaattgcaccctgatattggtgttaaggtgagtcggattgtgaacctagccgatgacattgccttggcattagccgccaaagacatccggattgaagcaccaattccgggtaaatctttaattggcatcgaagttcccaaccgaaagattgcgacagtttccttcagagatgttgttgaacatcagcctgataaccacggccacgtgctccaagtgccgcttggaaaggatgttaatggcaatgtgattacggctgatcttaccaagatgcctcatttactgatcgccgggtcaactggtagtggtaaatcagttgcaatcaatggcattattaccagtattttgctgcacgccaaacccagccaggtcaaattaatgctgattgatcctaaaaaagttgagttgggcgtttataacggcattccccatctgttaagcccggttgtttccgagcctaagaaagccgccagagcactgcaaaaggtggtttccgagatggagaaccgttatgaattgtttgccaaattcggccagcgaaagattagcacttataatgattttgtcgcgaaaaacaatcgtgaaaatgacactaaaattcagccgatgccctatatcgttgtgatcgtcgacgaattggccgacttgatgatgaccgtctccaatgatgttgaagctgcaattatccggctggcgcaaatggggcgggctgctggaatccacatgattttagccacccaacggccatccgttgacgtgattaccggcttgattaaggccaatgttccgtcaagaattgcctttgcggtatcaagtgggattgattcccgcacaatcatcgatactaacggtgctgaaaaattgcttggccgtggtgacatgctgtttttaccaattgactccaacacgccgattcgagttcaaggggcctttattcccgataaggatgtctccagagtcgtcaaattcattaccgatcagcaatcagctgattatgatgaatcgatgatggttagtgatgaagagatcaaagaagaggatcaagaagattccgaagacgatttattcaacgatgctttggcctttgtggttgatcaacagaaggccagcacgtcgcttttgcaacgtcacttccggattggctataatcgggcagcccggttaattgatgatttggaaaagcgtggctatatcggtccacaagatggcagtcggccgcgtcaggtctataaggaaaaacaagaataagtttgattgacaaaaaagaggctggcacaaaagctttcacttttgtcccaacctctttaagtcgtttgtttataagaatgtcatgattgctgaaatgaccagcgaactgatcgttgcaataatcatgatccaaacaaataccaatgtaattttttgaaatctggttctctttttacgcgccaatattcgcaccactttctcttgtattccatacacagtttaactatcattatcgttcaatgcaatatgttttgtcaaaatcaggagggtaactcatgcatatttctccttggatgactgacacggtaacctttataacgcaatttctgattctatttgcagttgccgggtttttagttgttttaagaaaaaatcaatttttcaggtcgaaggtgccgattaaaccactcgatttttggccgccaattttgctgtacttcattcacgagattagtaaaaagggtttgtcggggtcattcattcccgaagtggtgattgtttggttagggctcacattgattgtgttgatctggcaaatttttgccaatccgaatttaacctacaagaaattttttatcaccttttggcgattcagtgatttatttttattcggttgttggatcgtcgtggggatttatgtcatttttgagtctatctgaatcactagctgttcatcggatcaaagcagatttttatgctttggtctttttttgtgcagaaatgggcaaatctccccaccactttcttattgccgtcagatcagtcctggacggatttttagttgaatatgaaaacggtttataacaaaaaagtgacaaattttgaggaggcgtggttgatagtggtggattgtggtagaatgtgattgtaaactgaaattgggggtgatgacgacatgttcatgggtgaatatcaacacaacattgacgccaaaggacggatcatcatccccgctaagtttcgccaggatttgggcgacaaactcgttgtcacccgtggaatggatggctgtttatttggctatccgatgagtgaatgggaaaaggttgaacaaaagatcgacactttgcccgtgaataaaaaggatgctcgttacttcacgagattctttttctccgctgcagttgaatgcgaatttgacaaacaggggagaatcaacatccccgcaactttgagggattacgcaaaaattgagaagaaatgtgtcgttgtcggtgtctccaatcgttttgaaatttggagtgacgatcgctggaacgactttagtaatgacgccgaagagaactttaatgaaattgctgaaaatatgattgatttttagataagcagacatgctggaaacgggggtgatcgaatgtctgaatttaagcatgtaactgtcctcttaaacgaggcggttaaggggttgaatattaatcccgatggtacatatgtcgatgcaacattaggtggtgggggacataccaccaagattcttgaacagttaaccaatggccatctttattcttttgatcaggacgaagaggcgattgcttataaccggcagcacttggctgaatacattgaagccggcaaattaactttgattcacgataacttccgtcatttaaaatcagctctccaaaacgttgatgtttcggggattgacggaatcgtttacgatttgggcgtttcatcacctcaatttgacgaagccggccgcggattcagttatcgctttgacgcccgccttgatatgcgaatggatcaggataatccaatcgacgcctggaagattgtgaatgaatggccttacgaaaagttggtccggattttctatcgatatggcgaagagaagtttgccaagtcaattgctcggcggattgaaactgttcgacgagaacatccaattgataccactaacgatttagtcgaagtgattaaagaaggaatcccggcagcagccagacgccatggcggccatcctgctaagaaagtctttcaagcggttcgaatcgctgtcaatgacgaattatctgcgttggaagattcactggaacaggcgttggatttgttgaatgtcaacggccgaatcagtgtcatcacttttcaatctttggaagatcgcttggttaaaaccatgttcaaagaaaaaacgtccttgccggaattaccgcctaatttaccgatcattcccgaaggcattaaaccaaaatttaaaagtattactcgaaaaccaattgttccaactgaagctgagttagaagagaatcatcgatcacatagtgccaagttgagaataattgaacgaattaaaaactagataaaggaagagtacatattatggcacaaaataatttagctcgtaacctaaccgaacaaccgcaaccgtatgtttccagccctgatcaggctaaagtaaaacgggtgagcattgcaaaagccctcaaactttcgtcctttgaaaagctgttaattgtatgtggcagcgcagtcttaactgtgttaatgttagtagttgtatcgtcaaaaattgccttgtctaattcacagcatgaacttcagcatttagacaaccaggttgtgacggttcgcaccagtaatactaatttaaaacaacagattggtgagctgcaaagcagtacccgtctggacaaaattgcacacaagagcggcatgtcactctccaatgcaaatataaggaatgttactaaatgaaagagccatctgatcgttccgcagacaaactgaatgcccgaaaaagccggaaaattgttggaataagtttgttcctcgcatttttcctgctttttgcatttttaggcagtcgtttacttgtcattgcggttgggaaaaatgttaaaaatgtcaatttaaatgaccgcgccgaaaaactttatactcaaactcagaccctcaaagccaaacgaggatctatttatgatgcaaacggtaacccaattgccgaagacaccagtacatattcgctatatgctgttttggacaagcagcaaaaagggctgaacggcaaaccactttatgttgtgaataaaactaaaactgccagggtgctcgccaagtatttaccgatcaccgaaaagaaggcattgaaaattttatcccccaaggataaacagccattccaagtggaattcggcagcgccgggaccaatatttccttactgactaaaaagaagattgaagcagccaaactgccagggattgactttgtccaaaagcaggcccgcttatatcccaacggcgtcttttcatccaatttgattggggtggcggtttctgaaaccaacaagaagaccggtaccgccaacttggttggccaaatgggtattgaaaaagccttcaacaaaacgctagccggacagaatggctttaaaaacgcccagtacgatgtctacgggtacaagcttcccggtaagcagcaaaaagaaaagccggccaaaaacgggaataatatttacacgacgattgattcacggattcaaaccctgttggagagcgagatgaactctgttcagtcacaagttcatccggctggaatgaacgccgttttgatggatgccaaaaccggaaaaatcgttgctgcttctcaacgaccaactttcaacgcggcaacgctgaaaggcatcggttcggcttggaccaacacgttatcctccgatatgtacgaaccggggtcaacaatgaaagtctttacgctgtcatcggccattaattcgggtcattataacggcactgacacctatgagtctgggcgttattcaattgacggcaagattgttcccgattggaatcctgccggatggggctatatcacttataacaaaggatttgccttgtccagtaacgttgccatggctcatttggaacaacaaatgggtcccaagacttggaaaaaatacattaagcgatttggttttcttaagagcaccaatagtggccttccgggagaactcaccggcagaattcagttcaattatccgatcgaacaggctgacacctcatttggtcaaggaattgaagtgaccactttacaaatgatgcaggctttatctgccgtttcaaataatggtacaatgatgaagccgtactttatttctaaaatcacaaacccggcgaataataaaacgattaagcaatacggcaagcaagttgttggtcatccgatcactgctgcaaccgccaaagctgtcagaaagcacatgcaagacgttgtctacaagtcttacggaatcggtgccgattacaaaatcaagggctaccgggtggctgcaaagactggtaccgctcaggtcagcaacggaatgggcggttatgcttccggtgacgacagctatctctactctgtggctggaatggttcccgccaataatccacgctacgtgatgtttatcacgatgaaacagcccaaactgactgggaccaagacagctacacaattgctggcagagattttcaaaccagtgattacccgtgcgctgcagaactcgaataccaaacaggcaaccgtcaagcggcaggtaccaacggtgacctatcagacaacgacctatgccaaacgggtgatgaatgaaaaaggctttaatgttgtgacaattgggtctggcgattcgattctcaaacaatcgccgagcgctggaacaacacaagccgaacaaaagcgggtctttttactgacaaataaaggctggaagatgccgcgaatcattggctggagtaaagccgatgttgaaaagttctgctcgctgacaggcttaaaacttgagtctactggtagtgggtacgctgacagtcaaagcatcaactttgagaagtcaattgatacgggcgatgttttaaaagtaaattttgaataatgaaggatggtaaatggcgactatgggtaattggttaacacctttattgagtacatttgtgataacggcaatttttatgccaagtttgattaaatatttccgaagccgacatgaaggtcagatgattcgagaagaggggccttcgtggcacgaaaagaagtctggcacaccgacgatgggcggcattttgttcatcgttgcgatcgtcttatccgacttggtcttcggtggggcaaaagggatgttgaacccgacgcttctcatcttactgtttgtcctgatcacctatggtctccttggaatgtgggatgacagtattaaactgtttcggcgtcagaatgaaggattaaaggcctggcagaagatgctgggacaaattgtggccgccgtgattttctcggtggtatacatacacgaaggctttccaatggcgattaaaatcccgtttggcggcgaccttcgattaggctattggtacattttgttcattgtcttttggctggttggcttttccaatgctgttaatttgaccgatgggttggatggactggttgctggtctgggaacgatttcctttgcggcctacgggattattgctgccgttcaaaagcagacggaagtggccgtcttttgtttctcggttgtcggtggtttgttggcattcttcattttcaatcacaaaccagccaagatcttcatgggagatatggggtcgctggctctcggcggagccttggcagccgtttccgtgctggttcaccacgagttctcattgttgatcattgggattatctacgtatgcgaaacggccagtgtgattattcaggtggggtcgttcaaactgactggtaaacgggtcttcaagatgacgccgattcaccatcattttgaaatgagcggctggtcagaatggaagattgatatcgttttctggctgattgccttggtggcatccgccattagtgtgatgacgatagtatagaggttgggacaaaacggctggttttgtatccagcctatttgactattcatatgatgaaaaacgagggagtaaaatgaaaaaaattgatgattataatcataagaaagtattggttttgggtgctggtaaaagtggcacccacgctgctgaactcttaaaagaattgggggcaacagttgttttgagtgattccaaacccagttctgaactgcctgaagtcgctgagctgcaggacgccggcattcaaacggttactggtaaacaggatccggccatcttagacgatggttttgacattatggtgaaaaatcctggtattccatacgataacgcggttgtagctgctgccgtcgatcaccatctaccaatcattactgaagttgaactggcttcacaaatcaccgatgccgaaatcattggtgtgactgggagtaacggtaagaccacaacggtcaccatgataactgaaatccttaaccaggaacgtgccaaagggcatgcctatgctgccggtaatattggcatttctgcgaccgaaactgccaagaaggcgacggccgacgatacgatcgtgatggaactttccagttttatgctgctgggaattaagactttgcacccacatgtggccgttttgaccaatattttctccaaccatttggactaccataaaacccgggaaaattacgtgaatgccaaaatgcggatcaccatgaatcagacgcctgaagatttctttgtggtcaactttgattctgatgaatggcgcggcttaagcaaacgcagtgctgctaaggtcgttccctttgccagaacaactgagattgacaagggcgcttacgagaagaacggcaagctgtattacaacgacgaattcatcatgaatgccgaggatatcaaagttcccggaaagcaaaacgttgagaatgccttggcggcaattgcctgtgcaaaagtgctgggcaaatccaatttggcaatcaccaatgtgttggaaacgttcaccggcgttcgccaccggcttcaatttgttcttgaagccaacggccgcaagttctacaacgattccaaggcaacggatattgaggcgactcagatggcccttgaaggttttgacaaaccagttgttttattggctggtggacttgaccgcggttatacgtttgacaaactgattccgcaatttaaggaacatgttaaggctgcagtcttatttggcgaaactgccgatcttttggaagactccctgaagaaggccggcattcaaaatattcaaaaagttgataatatcgatgaagctgttccagcagcatactcatttagtgatgaaggcgacattgtgttgctttcaccagccaacgcaagctgggatcagttcaagacctttgaggagcgtggcgatcgttatattgcagatgtggagaaattgacgaataagcaggaggggcactaatgcgtttaatcatttctggtggcggtaccggcggtcacatctacccggcactggcaattaccgaggatttacttaaacaggaacctgattcagaagttctctatgtcgggtctcagcgaggcctggagagttccatcgttcccgagcagggaatcaagtttgttgccttggaaattcaagggttcaagcggtcgctgtcattggagaacttcaaaacggtggcgttgttcctaaagagcgtgcatgaatccaaaaagatcattcgagactttaagcctgacgtggtcattggaacaggcgggtatgtttccggagcagtggtttatgccgcggccaaagcccacatcccaaccatgatccatgagcaaaatagtgcggttggattaaccaacaaatttttgagtcgctatgtggacaagattgcgattggctttcatgaggcagccagtcaatttcctaaagaaaaagttgtcttcgctggcaatccccgcgcccagcaagtggctaatatgaagagtactttcaagtggtccgatgtggggctgcaagatggtgaaccgaccgttctcattttcggcggcagccagggggcaccggcaattaataagaccgtgatcggcgctgtcagcgagtttaacaaacgccagtaccaagtggttttcgtcaccggtcaaaagcgttatcaaaacgtgatgaatttgctggataaaacgcggatcagcagtaacttcaaaattctgccgtacataaacaacatgccgcaagtcttaccgaaagtttcgctgattgtcggtcggtcaggagctaccagcattgccgaaataacggccctggggattccagccgttttgattccaagtccatatgtcacggctgatcatcaaaccaagaacacgatgagtttggttaaccgcggcgcggcattgatgatcaaacaggaagatttgaatcctaaaagtttgttaaaggccgtcgatcagttgatgcacgattcaacggcacgtgagaaaatggcagagaattcaaagcagctcggcgtcgttgattccgctgacgaaattttgaatttagccagaacactgaccaagtagtctgataatcgggggtagagatcgttgggagcacaagaccaaaatgggaagaatcacggaggattgtttcgcgatttccaaaataggaacgtcaaaaaaatgtggccgttggtgatgctgattaccatcattttgttggtcatgatctttatgatctcgtcatacagtcgcgtgaaaaaggtcaccgtttccggtaatgagattgtcagcgatcaacaaatcaaggctttttcccctgttaagaagggaacgtcactgtttgctgtctgggggaaaacggacaagcttgcccaatccctcaaacaacgcagcagacggatgcaatcggtgaagatgaagctggtcaactttaatcaggtgaagattaaagtcgaggaatatccaacgattggctatctcttcgttcacggcggctatcagccaattttaaagagcggcgtgattattaaggggaaagttttgaatcccaaggccggttttccggttctgaagaaatttcaaaatcctaaaaaactgcggcggacgatcaaacagtaccgacgaatcagtccaccggttcgcgcagttatgaacacgattagcttttcaccgactaagagtaaccccgatcgaatttttattcagatgagtgacggcaacaaagtctatgcgtcaatcagtacatttggcgacaaaatggactactatccaagcatcagttccaagctgaaagtcaaaagtgtcatcaatttggaggtcggcgcctattcgtacccaatcccccaaaaacagacttcaacaaaaacgaccagtgtacagggctattagagctaattaatctttttcgatgtttatgattgtgttaaacttatgttatgttcagaaaatattctagatgtggaggttccttacatatatggataattcgggtttatatgtgggacttgatataggaactacctcaataaaagtaattgttgcagaaaaagtaaaagggcaattgaacgttattggtgtgggaaatcagccttcaaatggattgagccgtggtgtgatcgttgatattgaccaagctgcagacgcaattcggagtgctgtaaatcaagctcaagaaaaagcaagtattgagattaaagacgtgattgtaagtgttccggcgaacatgttacggattgagccatgcaatgggttaattactttggatgatcaatcacgtgaaatcactgaggaagatgtccgaaacgttgcggcatccgcacttggcaccagtttgccacaagaacgagagataattgatattcagccggaagaattcattgttgacggattcgacggcatcaaagaccctcgggggatggtcggcgttcgtctggaaatgcgcggtaagttaattaccggttcaaaaggcattatgcacaacctgcaaaaggccgtgaataaagccggtttgaatattatttcaactgttttaacgcctctggctgaaagccacgtggtgttaaatgacggtgaacaggactttgggacgattattgtggatcttggcggcggacaaacaaccgcttcagtcattcatgatcatcaattaaaatatgccacaaccgatcctgagggcggcacatttattactaaagacatttcaattgttttaaatacatcaatggaaaatgctgaaaagatcaaacgtgattacggttacgccgattcattgcaggcatcggcagataatgaatttccagttgaagtagttggccaatcagaaccaacttacatcgacgagcgttatctcgcagaagtgatcgaagcgcgtttaagccagatttttgatcggatcaaagatcgtttgaatcagattcaagcgcttgatttgccaggtggaattgttctgactggtggtgtggctgcacttccaggaattgccgaattagccgctgaccaattcaacactaatgtcagggtctatattcctgatcagatgggattgcgacacccatcgtttacagctgcactttcactagtgtcatactttgccgatctggcagacgttgatatgattgttcgatcggccgttggtgcaacattgaccaaagcgcctaagttgagtcagcctgagcagacaccaatgcctgcagctgggaagactaagaagaccaagaaaccgacacagaagaaaaaacgcggtgaaggaatcaagaatttctttagtgatttctttgattaagcacttaaacggagggaaaagacaattatggaatattcattagattccaccgataaccatggtgcaaacataaaagttatcggcgttggcggtgggggaagtaatgccgttaacacgatgattaactcagatgtaaaaggtgttgaatttatcgttgccaacaccgatgttcaggctttggcaacttcaaaagccgaaaccagaattcaattgggacccaaactcacacgtggtttgggagccggctccaacccggacgttggtgccaaagctgctgaagaaagtgaagaagcaatcactgaagcacttgaaggtgctgacatgattttcgtgacggccggaatgggtggtggtaccggtaatggtgctgcaccaattgttgctaaaattgctaaagaccagggtgcactcacagtgggtgtggttacccgtccatttagtttcgaaggaccacgtcgggcaaaatatgccgatgaaggagttgctcaactaaaagagaatgttgatactttaatcgttatttccaataaccggttacttgaaatggttgacaagaagacaccaatgatggacgcctttaaggaagccgacaatgtcttgcgccaaggggttcaaggaatttcagacttgattaccagccctggctacgtcaacttggactttgccgatgttaagaccaccatgcaggatcaaggttctgctttgatgggtgtcggcactgctaacggtgaaaatcggactgccgaagcaaccaagaaagcaatttcttcgccattgttggaagtttcaattgatggtgctgaacaagtattattgaacatcaccggcggaccagatttatcattgtttgaagcccaagatgcttctgacattgtgtcacaggctgcgacgagcgatgtgaacattattttcggaacgtcaattgacgaaaccttgggtgacgaggtccgcgtgacggttatcgccaccggaattgataagaaaaaggctgaacaggatcggatgtcaacacggcggacccgctctgctcgtccacagccaactgcccggccacattcagaccgtcaagctccagaaaccaatcaatcacaggattcttcaaatgctaagagtgatccacttggtaattgggacatcagaaaacaaccagcgccaactcgtcctgctgctcaggatgaatttagcgacgttgagaaaaaggatttcgatcctttccaacctgatgttaattctgacgatacaagaccagataccagtgatgattcacaagacgacattccaccattcttcaagcaccgtcgtcggggcaagtaacatcagctgaccggtgccgatgtttggtgaaatgtgaaaggacacgaaatgccaaaatttaatttagctaatttttttgggatggatacagaccaaccagaaaatcaaattgataagccggcggacaacgttgtattgatgaatcgacaagaactagaaaccagcagcattgttgtttttgaacccgttaattataccgatgttgacaccatcgcccaaaaactattggaggacagtgcggtcatcatcaaattggataaattggataacaattccgctgcccggatggttgatttcttgaacggtgttttgtttgccattcacggatcaatcaatcggctcggtaggaacatcttcatttgttcaccgaagaaatttcaagtaactgagtaatctcgagaaaataaggagcaacctattggtcacatttgttatgtatgcagtttggtttatcgacaaggctatcaacatttatatgctgtgtattgtcgtgtatgccctgatgagttggttcccgaatgcttatggaacagcaattggccgatttttggctcggattgttgaaccatttgaaagcttgtttaattttgccacgattgggatgattagtctcgctccgattgttgcattagcggtgctgacgttcgtccaaatgggcgtcaactatcttggacaattgttaatcggctactaattggggtatggacatttcagccagagggggaaatatcttggtagactcgaatgtttcgcaacactatcgacaggctgaattgccttttttagagtcaatcgacagtttgagcggcagggttgcgaatgaatatcgaccgatccttactgattttttaaatcctagacagctttatatacttgaaacaatcgtcaacagatacgagggtgtctcatttcaaacttttggtgggtatccctcagctgaattaaaacgagcggttgcctttccggattactttgttcccaaggccgatgattacaatattacggctttccagattgactatcccagtaaatttgccacgttatcccacggacaaattctgggatcgattatgggaagcggcattgatcgagatgtcatcggcgatattgtcaccgatggtttgaattggcaatttatgtgtgaatctgagatggccgattatgttcaatcacaagttgaccggatcggcaagatcaaaatcaagttgaaacaaattcagcctgaggagattattgcgccggttgatgaaggtgaagaattaacgacaaccgttgcttctttgcgggtcgatgcactcgttagtgaaggattccacatttcccgtcatcatgccaaggaattgatcgaaggcggcatgattcgaatcaattgggaagatgccaaccgaccggatcttgaaatttccattcaggatattatttcggttcgcggtttcggcagactggttgtccaagacattgccggtatgactaaaaaaggcaagattcggatcggattaaaagtatataatcgaaataaataggaggattgaatcattatggtattaagcccacaagatattcataacaaggaattttcgacaaaattacgaggttacaatgttgatgaggttaacgattttcttgaccaagtcatcaaggattatcagatcgttttgcaggagaacaaggatttgaactctcagctaaacgaagctaaggacaaactttcctactttaacgatttaaaagattctttgaaccagtccatcttggttgcccaggaagctgctgataaggttaaaaccaattcgaagaaggaagctgaaattaccagccgtgaagctcaaaaaaaggctgacgatattttgaatgctgccaacgaaaaggcggatgccgttttggaagaagcttcaaaacgcgctaagaagttagcgattgaaacagatgatttaaagaagaacaccagggtattccgtcaacgacttcaagtcatgttggaaagccagctcgaagtcatcaaagggtctgattgggatcgcttggttgaagaaaagccaaccacaacttacgaagatatcgaaaaagttgttggtagccttgacaacattggaaacccaggggtacaatctgaaactaaacagagtaatggcgctgcagatgttgaagaaacaccggctactgtggatgattcaaaccagaccgtcgtgatttatccagatggtcgcacacaaaatgaataattaatcgattagagaaaagaaagttattggctgaaacaacagcgagctgaagatagtgggagttcagcagtcaccaaccggtaaatcgatcacctctagtacataaatcgattatctgaagagatagaattttaaattctaaaattgggtggtaccgcgaagacttcgtcccttgtgacggggtctttttttgtagagtgcgacgagggttgcgttttagcaatactacccaaacttcatccaccaaccaaatttctcaacatcaacacatcatcactccactaaatatctccatgaaaggaagtccagcaatgcgggtaaaagatacattaaacttaggcaaaacaaagttcaaaatgcgtggtaatcttcctgttaaagaagtcgatcgtcaaaaggcttgggaagacaacgatgtttatcaacaaagacaaaaattaaacgagggcaaaccaacatttgtccttcatgatgggcctccatatgccaatggtgacattcatatgggccatgcgttgaacaaaatttcaaaggatatcattgttcgatacaaatccatgacaggttaccgggccccttacgttccaggttgggatacccatggcctgccaattgaacaaaagttgacgcaagccggatatgaccggaagaagatgtcgaccaatgatttccgtaaattgtgtcgggattatgcgttgaaacaggttgaccgacaaaaagaagaattcaaacgtctgggtgtttcaggtgactgggacgatccatacctcactttgaagccagaatttgaagcccaagaagttcgggtgtttggcgccttcgctaaacgtggcttgatttacaaaggtaaaaaaccagtttactggtcatggtcctcagagtctgccctcgctgaagccgaggttgaatatcatgacatcacctcaccaaccgctttttatggtgaacacgtcgttgatggtaaaggtgtcttggatgacgatacctacatggtggtttggacaactacgccatggaccattcctgcttctgaaggaattaccgtggatgccggatttgattattcagttgttcagcctgaaggcgaaactcggaaatttgttatcgccactgagttggttgataaagtcgccgatctcattggctggaccaacgtcaagacgatcaagaccgttaaaggccaagaccttgaaggcattttggcagaacatccatttgatcatagtcgtaaattattaacgatgttgggcgatttcgtggaccttgaagaaggaaccggattagtccataccgctcctggttatggtgaagatgactttaatatcggccgtcaatacggtctggatatttttgcgccagttgacgacaaaggctacttgactaaagaatccggtgaagactttgccggcgttttctatgatgatgccaacaagattgccttggataaattaaaggacgctaagttgttgcttcactacatgccgttgaagcatagctatccatttgactggcggaccaaaaagccgatcatcttccgggcaacgcctcagtggtttgcatctgttgataagattaaagatgaaatcttaaaatcattggacgatgtccaattcttccctgattggggcaaggttcgactatccaacatgatcaaaaaccgtggcgactgggttatctcccgtcagcgggtttggggtgtgccactgccaatcttctatggcgaagatggtgaagcaatcattactgaagagaccgttaaccatgtagctgatttgttcgaaaagtatggttctgacatttggtttgaaaaggatgccaaggacttattacctgatggtttcacaagtgagcattcaccaaacggaaagttcactaaagaaaatgacatcatggatgtttggtttgattcaggctcctcccaccaaggggtgcttgaagaacgtaaagagctgacttatccggctgatatgtaccttgaaggttcggaccagtaccgtggctggtttaactccagtttgattaccagtgttgcggtttctggtaaagccccttacaagcaagtcgtttcccaaggatttacccttgatggcaatggccataagatgagtaagtcacttggtaataccattgcaccaatcgatgtgattaagaagatgggggctgaaattgtccgcctgtgggttacctccgttgatacttcagctgatgtgcgggtaagtaccgagaacttcgtcaaggtttctgattcttataagaagatccgaaacacgatgcgattcttgttggccaacacgtcagactttgatcccaaagaaaatacggttgcctttgacgacttggaatctcaagatcaatacatgctggtgctcttcaataaattcttagccgataccagaagctatatggaacgatatgacttcctggactggaacaagaaggttgttggatttattaccaatgatttgtccgcattctatctggatatcgccaaggacattgtctacattgacaagcaggacggtcacaaacgccgttcgatgcagacggtcatgtatgagattgccgttggcttaaccaagttaatgactccagtgttgcctcataccactgaagaaatttggggcttcctccacgaacccgaagaatttgttcaattaaccgatattccggaacccaagaagtacgaccacgattctgaaatcctggccaactggacgaaattccgaagctatcgtgatgacgttttgaaggttcttgaagaggctcgtgacgccaagaagattggtaagtcatccgaagccgctttgacgatttacgcaaccagtgaagtggctgacttgatggacagtttacagaccgatttggcaactgttttgatggtttctcaattgacgatgaaggactttgctgatgcacctgatgacagtacgaaatttgatagcgacggcttggcattatcagttgaacccgctgaaggcaagacctgtgaacgctgccgtttggttcgccaagatgttggtgcagacagtgactacccaaccttctgtcaatcctgtgcccaaattgtccgtgaccagttccctgaaaccgcaactgaaggttttgaggaaaagtaaagcggcctttgagacgttgatcgtttaaatttcatcaaaagctgttccaatcttcatgattaaacattaaaatgagactatgacttaaatgttgtagtcttatttttgtgttttaattaattgaaatgtgctttggctcacagattgtgccaaacaccttggaggatattttgcttaaaggaaaaattaaaagttacaacccacaaaatgcatttggtttcattacccaagacagcggtgaagacgatctgttcttcttcaaaaatgcctttcctgaagatcaatacggcaccattcaagttggcaagccggtagaatacgttgtcgttgccggacaaaagggaccgcaagctgccaaggcgcacgtgatcgaagattagccgtcttgattgcaatgacccggtattatttgtaaaatgatattattaactaaaaaaggtgatcgagttggactttgaagaaaaagtaattggcacagagaagatctacgatggcgcaattatcaacgttgaaaaacagacagttaagctgcctgacggacagacatcatttcgagaaattgtccaccattccggagcggtcgggatcttagccctcactcacgataataaaattattcttgagaagcagtggcgggcaccggctaaaaagaccaccattgagattccggcaggaaaagtagacggacgggatgctaattttcacgacaccgtcattcgggaattgaacgaagaaatccgttatgttcccaacaccatcaaagaactctatggcttttactcgtcagtcggcttttctgacgaatacatgaaattataccttgccgaaggcctgaaacctgttgccaatcaattgccgcgggacaaaggtgaattccttgaagtgtttgaaaaaacgctggatgaagctgtggcaatgattgcggatggcgagattcaagatgcaaagaccattactgccattcaatattggcagttaatgcaaaagtaggtgaccatttaacttggcgatcgatgataatcacaaaaatgacggaaaaccgttaacgcgagaacagtatcgaaaattaaaattacagcaggaagcagactttgaggcccgcgacaaacggcgggttcaagtcgaacgcgaatatgcaagaaaacaccaacagccggtttccgaagcgacgcctgaacctcaggaaacgacgcgggcacgtgaaaatcatccagcagatgacgatttcaaaacgccgcgttggcaccggattaaccgcaaactgaattggacaatcacaatcttaattttattgatggtgatcgtttttttagtgttgttttttgtaaattaaggagaatttgaatgacttacggaattatttgtgcaatggacgaagaactggcaatcttaaaagaagccttgtctggcgaagaaaccaagcattacggcaatgctgattattatttgggaacaattcacggccaaacactggtcatcgttaaatcagggattggtaaagttcaagccggcatcacgacctcaactctgatcaatgaatttcacgtggatgccgtgattaactcgggttcagccggtggcatcggtgaaggtttatcggtcggtgacatcgttgtttcgaccgagacggcctatcatgacgtggatgtcaccacttccggttaccaaatgggccagctgcccggctttcccgcccgctttaaagcctcagaggaactcgctgacaagattgtcaaagcggcccaacaaagtggcgtgactgcccacaaggggttaatcgtttccggtgaccaatttattgccgattcaaacaaaattgctcaaattaagcacaactttcccgatgccctgtgttctgaaatggaaggggcagctgttggccaagtggcctatcaaaacaaagtgccatatgcggttatccgggcaatgtctgacgttggtgatgaagaggcagaagtcagttttgacaaatttatcatcacggccggcaaaaagtccggtcagatgttgattgacctctttaagaacgagtgactttaaggagtgaaaataatgaaagagatatatcttgataatgctgcaactaccccggtttctgatgaagtatacacagaattaatggataagtataaaaacatttacggtaacgcttccacgctttacggcctggggagagaatccaaagccgtcatggaaaatgcccgggatgtgattgctaaaagcattaacgctgatccagacgacatcgtctttaccagtggcggttctgaaagcgacaatacggcgattacccaaactgcgattgcccgcaagtcactgggcaatcacattatcacaaccgccattgagcacgaagccgttatcaggccgtgtgaggccttggagaaaatgggctttcgggttacctatcttcccgttgacgagtatggcaacatctctttagacgactttaaggctgctttggacgatcagacgatcctggtttccatcatgactggaaacaatgaggttggttcaattatgccaattcatgaaatcggtgaaatcttgaaggaccatcaggcttggttccatacggatgctgtgcaggcatatggtttgttggatatcgatgttcaacgtgaccatattgatatgctgtcgacatcggcacacaagattaatggtcctaagatgattggttttctctaccggcgtaaaggggtgaatttccctagtttaattaagggcggcgaccaagaggaaaagcgacgtgccgggactgagaatgttcctgcaattgccggatttgccaaggcggtccaaacgatcacaccagaagagaaggcgcaccgacaagccaaatatttgaaatttaagcagtatatcgctgataaattgaagcaaaacggagtcgagttcgaggtcaacggtcgaatcaccgaggataatttgaaccacgtcttcaatatttggcttaaaggcatctcgacttatgtgatgcaaactaatctggatctggcaggaattgcggtttccggcggatcagcatgtacggctggtagtatcgagccatcgcacgttttggtggcaatgtacggcaaggatagcccaagaattagtgagtcgattagaatcagttttgggcgttacaatacgactgaggacctggataagttggtagatgcaattaccaagattgttaatcgggtcaaaaccaagggggtaaagatgtaatggcattcgcaaaaacaggtaaggttaacggtgatgatacagtgtatgaactaagggataacgttaaacggttcacactgcgtgatttgggatttattgagggcaagaccggtgtcttttcactggaaaagtcattagacccaacatcgccgtataatgccaactataaattcaaaatgaaggttgataaggatctaagtggttttagaatggcgatcaccacgggaaatggtctggaaaaagtcaacatcttcaagaatccggatacccaaccaagtgtcgagcaatatcaatttattattaacgatttgattgataggggtgtgctaaaaagaagagtgtgacgagagccggttagggcccggaacataagtgattaaggccaatgacgaacgctttttgttcgtcgttggccttaattgcttatgtggtagggccctgggtctcggaacacgtttcagctgagtaacagtgaactaaacactatatgggaggaaaaggccaaccaccaatttaaacaagtaattgtacatcacaatcaaacaaacccaatttgcaacattcaatcgttgggcccgggcaaaactaatcattttgcctgggcctttttacagtctgccattctacctagtcgaatcttgcccccatcagcagcttccggccatataagcgggggacactgttttttccaagattaacattgacacgtccacgtaaaagcgataaattagattataattaagatatgatgataaacggataagtgatgatcttatgaacaatttgtgtttcacgttcgtctgatgatttcttacatatctgaattgtagaaaccatacttagttacaacgcttatcacctgcttaatcaatattttaaggaggacacatatacatggcaaaacaaaagttagaagatttagattggaccaaccttggattcgcctatcgtgatttaccatacagttacaacgaggaatttaaggatggcaagtggcaaaacggcgggttaaccaccgactcaacactgactttcaacgaagctgctgaagatttgcattatggtcaggaagtttttgaagggatgaaagcctatcgtaccaaggacggccgaattcaacttttccgtcctgacatgaacgccaagcgctttacgaattctgccaaacgtttggtaatggaaccatatcccgaagataaatttgttgaagccgttaaagaagttgttaaagccaacgctgattttgtgccaccttatggttcgggcggctcgctttacatccgtccgttcatggttggaaccgaaccactggttggcgtttcaccttcgtcaacttacaccttccacatctacgccaccccggttggtgcatacattaaaggccttcatccaatgccatacatggtcagcaaatatgaccgggctgcttacgctggtactggtcaggctaagactgccggtaactatgccggaagtttgttagcagctaaggaagctaaagataacggctttgccggcgaactttatttggacccacgtcaacataaatacgttgatgaatttggcggtgccaacttctatgcaattggcaaggacggcaagttctacacaccaaaatctcattcaatcctgccgtcaattaccaagaaatcgatcttgcaaattgccaaagacttaggattagatccttctgaaaccaacatcgatgtcaatgacttggatgaatacactgaagctggtgccatggggacggctgcggttatttcaccggttggctctttaaccaacaatggtaaaaagcacgtcttttacagtgaaaccgagccgggacccgttacacaaaagctttacgatacattatttgggattcagtcaggtgatgttgaagataaatatggctgggttgttccggttgaataaagagtgggacttaaagcggttagtttccacgtttccgcaaggtaatatttaaaatcataaaagttcaggtgagacaaacaatatttttgtctcacttttttgaccgccgaatcccttggaaagtgtttgacattttttctggcaaacattagaatattagaaaatggttagaccgatgacaactatttactacatatcctcaggagggacactatggcaaaagcaaaaccggcaacagaaattgattgggaaaacttaggcttcgattatatggacttaccgtatcggttcttagcgcattatcaggatggtcagtgggatgaaggtcaactcactgaagatggtactttacacatcagtgagggctcgaccgggcttcattacggtcaggctgatttcgaaggcttgaaggcttatcgaaccaaggacggcagtattaatttgttcaggccggatcaaaacgccaaacggatgactaaatcctgtgcccgtttattgatgccggcatttccggaagataaatttgtggcagcggttaaaaaagtggtcgctgccaatgccgactatgtgccaccatacggaacgggcggaactctttacttgcgtccgctgatgattggtgttggtggtaacatcggcgttcatccggctgatgaatacatcttcacgatttttgccatgccggttggggcttactataagggtggtctgaagccaaccaatttcacgacttcatactatgatcgggctgcgcctcatggcactggtcaaagcaaggttggtggcaactacggcggcagtttgctgcccggtgaccaagcccacaaagccgggtattctgacgtgatttatttggacccggcaacccataccaagattgaagaggcggggtcagccaacttctttgggattaccgcagacaatgagtttgtcacaccaaaatcagattcgattttgccaagtattaccaaatattcactgttgtatctggcggaacaccgacttgggttaaaggccgttgaaggtgacgtcttcattgacgatttagatcgattcgaagaggccggcgccatgggaacggccgcggtgattgcaccgattggcgggattgaatataaggacaacttacatgtcttttatagtgaaacagaagttgcaccgattaccaagaaactctacaacgaactaaccggcattcagtttggggatgtggaagctccagaagcttggattcaaaaagtcgaagtttaattgattaacaaatgatggcaccagaaaagagggctgggacaaaacgaacggttttgcccggccctttgtgttttaattggcgatttgctacacaccaggttagtcgatggtctatgaaaggatggtcattgtgatcaaacgagaaggtcattcccacacagaattttgtccccatggaagtggggatgatgtggaattaatgattcaaaaagcgatcaagctgggttttgaagaatacagtattaccgaacatgccccgttgcccgaaggactggctgataagtatgccgggaaaacaaccggactcacggaggcctcaatggcggccgctgatttggacgcttattttcaaaaagccaaccaaatgaaggccaagtatgcggaccaaatcaaaatcaacattggctttgaagttgacttcttgcctgattttgtcgattggactcgcgactttttgaacgaatacggcccgcgaacaactgataatattttgtcggttcacttcatgcaaggggcaaacgataaattctggtgtgtcgatgatactgtggaagatttccaggccggattattgagtcagtatcccgactcacaagtcctatatgagcattattttcaaaccgtcctggcctccgtgaatgctgacttgggtccgtacactcccaaccggattggccacatgactttggttaaaaaattccaagattattttggcttggatcgtaacttttctgagaacaatctaagactggttgatcaaattctcaaggcggttagcggtcaacaccgtgaactggatttgaacgctgccgggttgtacaagccctactgtaatgagcagtacccgtcctattcagttatccagatggcaaaatcgttaaacattccatttgtttatggcagtgatgcccatagtattgccgaagtcggtcagggttacaatggcgtgatttcattagttgaataaatcgcttgacaatcgatggtttggtgatagtatatgaaactaaataaagcaaaagttaatataataaagttttgattagaaaaagtaaccagtggtaatttaaaagagagtgccattgctgaaaaggcacattttacactggcgaacacacatctatgaactaaccggttgaaccaagtaggccggttcgcatgtttagcgttatcagggttaccgtatctgttatcagaggatgactagatattggcaacgtaaggccgactactgtgaggtagcggcaaattgaggtggaaccacgactttaaggcgtcctcgaagactgaatacagttttcgaggactttttttatcgaaataggaagtgacagttatgaaaaataagaatttaccaatcggcacccgtgacgagtttggcacggaagcggaagtcaaagaaacgattcaaaataaactttttcagggctttcggcggcggggatttcgtaagttaaccaccccggttttagaatattcagatgtttttcaacctctgaatgccgaaaattatcgtccctaccaattattggacgagcaaggcgaaccactggttttacggcccgatttgaccctcccggttgcccgagtcatgagtacgaccggcattgagctgccagtgaaatggtattacggcggcgacgttttccgagtaaagaagcagttatccggaagttataaccaattaactcaggccggaattgaaattgttgggtacaagggcttgaaagccgattgggagtgtctggaagttgctttagcaggatgtcgggacatggccatcgaaaatgtcacgattgaactcagtcatgccaagtttgttgatgtgctgattgatcggctggatttgccggagcccaccaaagctggtttgaagcaagcgttgttcgccaaagatctcagcaagtacaaccaactcgcacatccactggcagaaacaccgttttcatcgttcgtcaatgaatggccgtggttgtttggcaattttgatgaggtgatgacagtcgttgacacattaccgccgattgaggagttggcggggatcgttaatcacttaaaatcaacggcggccttcatccaagagttattccccaaagtcaacgttaccttggacttaagcattccttctccacagagctattacaccggcatggcttttcgcggctttaccgataaatcctcaggctatttgttcagtggtggtcgctacgatgacttattaaccaatttccaaaatgtcaaaacgtctgccgtgggggtggcattcgacgttgatgccttggtcgaacggaccagcttccctgatgacacaccaaccacgctgatcttctttgaggacgaccaatggcaggaggcagaagcggctttatccaagttcgccaatgcgaccctctgtctgaccgacgattttgaagctgctaaacggctggcagccagtaccaacagtcaactcattgatttaacaaaagcaggtgaaaaatgatggaacgaattaaaattgcccttactaaaggccgaaccgaagatcaagtggtcccattactggaagcagctgggattaactgcgaggggattcgcaacaagcaacggcggctgattttcgatgaagatccccgttacgaaattatcctggttaaaggcccggacgtcctgacctatcttaacagcggttcggttcaaatcgggattgttggcagcgacatcctggccgaacaagaaaatttccaatacgcaatgttggatctcaacgtcggcaaatgccggtttgtcttggcatcaaccaaagatttcaatccccaggcccaccggcgcaaaataattgccaccaaatatcccaacattaccaaacggtattttcaagggattggcgaagacgttgaaatcatcaaaattgaagggtcggttgaactggcgccattgattggcctggccgacgcgattgtcgatattgtcgaaaccggcaacaccctgcgtgaaaacaatctccaagtcttcgcaaaactacagccagtcaacaccaaagtcgtggttaatcgattggcacttcgccagtaccaacctcaaatcaaaagcttgattgccagcctcgccaaggccgacgatcaactgatccaatccaaattaattaaggagtgagcaaaatgcgaacagcaacgatttttcgcaacacaaatgaaacccaaattgaattaagtctcaacttggatgactattcaaagattcaaattgataccggaattggctttttcaatcatatgctggatgcatttgcccgccacggccgcttcgggttggtggtcaaagccaaaggagatttagatgttgacccgcatcacaccacagaagacgttgggattgctttgggactggcactcaaacaggcgttaggcgataaagcaggcatcgaacgatttggctccgccttaattccgcttgatgaaactctcagtcgagtggttatcgatttgtccggccggtcttatctggtatttaaagccgaatttgccaacgaccacctgggcggctacgatactgaagtcactgaagacttcttccaagcattcgccttcaacgctgaaatgaatcttcacgcagaagttttatatggcagaaatacccaccacaaaattgaaacacttttcaaggcgctgggcagatcccttcgagcagctgtgaccatcaatccagaaatcaaggggatcccgtcgactaagggggttatctaatgatcacaattattgattacgacactggcaatacccgcaacgttaaaaacgccttggatttcttgggcgttccaaatcaattatctgccgatcccagtgagatattgacggctgatggattaattctgccgggtgtcggcgcctttaaaaaagccatggattctttaaatgaacgtggtttagttccggtgattcaacaggctgccgatgcaggaatcccaattttagggatttgcctgggaatgcagattctgtttgataaaagttatgaatttggtgagtcaaacggtctggggttaattgccggtgaagtggtgccgattcctgagaatttgggggtcaaggtccctcacatgggctgggatcaaaaccagtctcagcagaccgatgcacttggagatgggttcgacggtcagttcagttactttgttcattcctactacgttcaaacggcggccgaaaacattgtttcgacagtcgattatggcgtccagattccaagtatcgtgcgaaaagacaatgttattggttttcaatttcatcctgaaaagagtggtgaagttggactgaatggtttggcaaaattcaaggagatggttgaaaatgcagattattcccgcaattgacttaaagaatcaacaaagtgtccggctttatcagggtgatttccaacagacaaccgttattagcaagtcgcccttacaacaggcagtggcaatcgattctgccggcttgaaaaatttgcatctcgttgacttggatggcgccaagtcaggacggccggtcaatcgggcattgatcgaacaaatctgcgcccaaactgatctcaaagttgaagttggcggcggaattcgctcactctcccaaattaatacttacctgacatcaggcgttaaccgcgtgattctggggtcagcagccctgaacaaccccaagttggtgcagcaggccatcgaacaatttggcgctgatcaaatcgtcgttggcattgacggcaaggatggtcgggtggccgtttcgggctggctggaacaaagttccgtggaaatgggtgaactgatggcctcaatggtggcctttggtgtcaataccttcgtggtaacggatatttcccgggatgggacgatgactgggcccaataccgctcagctcagtagcctgcaagccaaatttcctcaagtcaccgtggtggcttccggtggcatccgtaacgtttcagatcttgaggatttgcaaaccgctgggattaaagcagcgattgtcggtaaagcaatggcaacgggtgatttaccgctcgatgtcttggcggaggtgaataccagtgttagctaaacgaattattccttgtttggatgttgaccacggccgagtgaagaagggggtcaactttgtcaatttgcaggacgttggtgatccaaccgagattgcggctgcctatcaacaacaaggtgccgatgagctggtgtttttggacatcaccgcgaccaatgagaagcgtaaggcgatcgttgagaccattgaaaaagtcgccagccaagtcttcatgccgctgacaattggtggcggcatccatagcgtcgacgatatgcaaaatctgctgaaagccggcgccgataagacagccgttaattcagccgctgtcagcaacccccagttaatcacggccggagctgaaaaatttggcgctcaatgcgttgtgttagccattgatgccaaatggaatccagaatccgggcagtatgatgtgtacgtcaacggcggccgtcaacgcacgaatttaaatgcgattgagtgggccaaaaaaggggttgcgctcggagccggtgaactcttagttaccagcatggataaagacggcaccaagagtggttatgatattaacctgtacaaacagctaaccgctgccgtgaacgtaccggtgattgcttctggtggctgtgggcaactgggtgactttgctgaagtctttgaccaagcagatgttgacggtgctttggcagcctcggtctttcactttggtgaactgacgattgctgatgtgaaaactgatttacgcaaagacggggtgatcgtacgatgaaacctgattttgaaaaatattcagacggcctggtaccgacaattgtgattgatgacaataccaaacaagtgttgatgatggcctatgttaatgaagaaagtttcaatttgagtatgcaaaccagacaaacctggttttggtctcgaagtcgccaagaattgtggcacaagggtgaaactagtggcaatacgcaagaaatcgtttcaatcgatattgactgtgatgaagatactttattgatgaaagtgattccggccggaccggcatgtcataccgggcacaccagctgcttttaccggaccattttaccggaaccaaccaaggaggaataatatatgcaagatttagacgaactttatcaattaattttggaacgcaaaaacaaccccgagaagggctcatacaccgattatttatttaccaagggtctcgataagatcctgaaaaaagtgggtgaagaagcaaccgaagtggttgtggctgcgaagaatccgtccgatcccgactttattttggaagttgccgatttggcctaccatgtcgaagttctgatggcccaacgcggaattacccccgaccagattaagcaggagcttgccagccgtgaaggcaaaaaaagcatcaccaaggatcgtaaacaaattaaggagtggtaggaatggtcaaagaagccgtcaaaaatctggaaccgtacgttcctgaactcactttggaacagatgaagaagcaaaaggggctggataagttagtcagaatgtccgccaatgaaaacgcttatggcacctctggtgacgtggccaaggcactggacaagtggcactatcgcgatgccaatctgtatcccgacagtaacgctgatgagctgcgggaaattattgcttcccagtttgatatcaacgccgacaagttgatctttggcaacggcttggatgaaattatcgaattgctgtcgcgggtgattcttgaacccggggatgaagttttggatccggcaccaactttttcagaatatgccctgcatgcagaaattaagggtgccaaaatcaaatcggttgggctggacgactccggccggattgatttaaaagcaatggcccgctcaatttcttccaagaccaaaatgatctggatttgtaatcccaacaatcctaccggaacttttctggaggctgatgccatccgggcatttgtcgaagatgttcccgaagcgatcacggtaattgttgacgaagcctacattgattttaccggcggcatccatgactcggtcatccagttgaccaaggaatttaagaacctggtggttttgcggacattttccaaggcttatggtttagccaatttcagggtgggctttgccgtttgctcagatccattgattggctatctgcaggcagcgaggttaccgtacaacctgagcacctttgctgaaattgcggcaaccgcggcatttaaagaccagtcattcgtcgacaataccgtcaaaaaagtcattgccgaacgcaaaaagtgggaacatttcttaatcaaagccggcttgccgttttatgactcggcaaccaactttattttcttccaagtgaagggtggggatgctgatgcgcttcatgaatatttgttggaaaatggttatttacttcggaacggtttacgcaaggactggctgcgagttaccatcggcagaccggaagacaatcaagccgttcaaaaattgattgccgattatcttgcttaaacatttacttacaaaaagtagcattcatttcgagaatgcgttaatattagttttactggaaattacgaccttcaactcgtggattctccagaatctaattgaaatgatggtggttttatgcaagacaacagtcaaacacgtgttgttgttggaatgagtggtggtgtcgactcctcagtcgtcgcttatctgctcaaacaacaaggatacgatgtgattggcgttttcatgaagaactgggatgatactgatgaaaacggcgtatgtactgcaaccgaagactataaagacgttgctaaagtcgctaacaagatcggcatcccatattattctgtcaactttgaaaaggagtattgggaccgcgtgttcacttacttcttggatgagtataaaaagggcagaacccccgatcctgatgtgatttgtaataaggaaatcaagttcaaagccttcttggattatgctttggaattgggtgccgattacattgcaaccgggcattacgcccaattaacccgtgatgcagacggtcacaatcatctgctgcgggcatccgatggcaacaaggaccagacctacttcttgagccaactttcagctgaccagctggaccgggttatgtttccaattggtaacctggttaagccggatgttcgaaagattgcccgtgaggccggcttggcaactgccgacaagaaagactccgttggtatttgctttatcggcgagaagaacttcaagaacttcttaggtcactatctgccagcaactcccggcaagatgatgaccgttgacggcgaagttaagggccaacacgatggtttgatgtattacaccatcggtcagcgtcgtggacttggaattggtggcgatggtgttgataaccagccatggttcgttgtcggcaaagatttaaagcagaatattttatacgtgggcaagggttatcacaatccattgttgtatgccgattaccttgaggcttcagatattcactgggttaataacttggaccgcggcaaggacttccactgcaccgctaagttccgttatcgtcaaaaagataccggcgtgaccgttcatatcagtgatgacggccagtcggttcgcgttgattttgacgcaccggttcgtgcaattacaccgggacaagccgttgtgttctatgatggcgacgagtgcctcggctctgcgattattgatgcggcttacaagcaggctaaagaattacaatatgtttaatctgaaaaagttgacgattgtcgtcaactttttttgtgggctgattgcgcttgttaggaaatgcaacagtgattcctggataatcgttatcatcagttgttacttttaattgagcttcaaaataaaaacaaatttttcattataaatctcgttaggcttttgaaatcgaaccgttttcctgtcataatgtaagaagctaacagcagtttggaggaatgtcatttgactaagttgtactttgttcgccacgggaaaactgaatggaatcttgaaagccgttatcagggtgccggcggcgattctccgctgctggctcagagttatacggaaatggatctgttaggcaaacattttcagaaaaccgattttgcccacatttattccagcccgattaagcgtgctcgggtgacggcggctcgaattgaccgcaaattaaagagccatccggatatttcactcttatccaggttggaagaatttcacttggggaaaatggaaggccaaaagtttgccgatgttgagcaggcttaccccgaagagtttgaggacttccgcaaccatcccgatttgtacgatccaaaggccatcggtggggaaagttacttggatgtgattaaccgcatgacgccggcaatcacttcaattgttaaggcctacccggatcaaaatgtgatgatcgtcagtcacggggctgcgcttaacgctgagatcaatgcgttgctgggtgtgggactgcccaatttacgaaaacgcggcggcctggcaaacaccagcacgacgattttggaaagcacagatgaaggacaatcctatcaactgattgattggaacgacaccagttatttgaacaaaaaattagacccgacagatttggtataggtgacaatatggcaaataattcagataaaattaaaaaattacaagcaaaaaatcaagcaaatcagcgtaaatatactaagaagcgcgaggctgaagaggcgaaagccaaagccacgattcataaactagttgaaaaagtggatcacgaacccgacaattatcacaattactatgatttagcgacgttcctggttgaagctaaagattacgagcaggccgaagagcttttaatgaaggcactcggcttatttgacaagtccaaccaagacgtcaaagataccctgaaatttggtcttggaaatgtctactatgccgcggcggaatacgataaagccatcaaaatcttccaagaaatcgaagacaaaaagcttcaggccgaatcctatattatgctggcccaaagctatatggccaagggtgacaacaagcgggcgatggtctttgctttatcggctcaaagtgcccggcacgatgaccctgacgtcaaccaaatgattggtgacaatctcttggccctgggtaactttgcccaagcgggggacttttacgatatcgtcttgaaaacagagcctgaaaacggcaaagccaactttaatcgcggcctggttgccatggtgaatggcgaagattttgaaaactattttgcaaaagccaagcaggctgatccggcttattttgaaaagggtcaacaaaagttgaaagatattgaaaaagtgatccagatcaacaaagacaagccgaagaagtaaatgtcagcatgagtaaggaggaccgtcttggaccattcaatagatttatttggctcagaacagaataatcacgaaccacaatatgtcgatggccgattaaaggcgatcttcttttcgagtaatgacagtttttataaagtcgtcttagttgaaattacggagaccaatgtcaattggccggaagacgaaatcgtcgtcaccgggaactttggcgatttggttgaagaaaacagctatcatttcaccggcaaattagtcgatcatccccgttatggcaagcaatttcaagccagcaactacaccagtgtgatcgccactaccagagaaggggtcgtcaaatatttatcaggcgatcagttccccggcgttggtaagaagactgccgaacgggtggtggatgttcttggcgatgatgcgattgaaaagattaccgcggataaccgtgtcttggatgacgttcccatcagcgccaaattgcgatcggcaattattgaaaatcttgacgccgatgataacttggaaaagaccattgttggactgaacagctatggtttttcgagtgcgattgcttcggcgatttaccaaaaatatcatgaagatgctttgaaaatcatttctgataatccctaccaattagtcgaagacattgacggcatcagcttcaaaaaagccgacgccattgcccttcgattggggattgtgccggattccaacgaacggattcgtgccggattgatgtatgcgattgatgaattatgccttcaaaatggggacacatataccacaaccgccccattgattcaaactgccacgagccttctggaggggaattcccagcagcagattcctgggaaaaagttggccgagagtttggttgaactggctaaagaaggcaaggttgtcggcgaagaagaccgcatttatttaacccggctatacaacgccgaagtccaaattgccgatcatttgaaccgggtgatcaaaaatcaggatgatgaagatcatctcaaagaagatgcgatcaaaaagcaattgcgagtcgttgagaagcagtttgatattaattatgatgattcccaagttgccgcgattgtccaagccatccagtcaccggcatttattttgaccggtggcccgggaaccgggaaaaccaccattatcaacggcattgtcaacacatttgcccgactacatgagtattcactggatattaattcctataaagacaaaccgtttccaatcgtgttggccgcaccaaccggtcgagccgccaagcacatgactgaatctaccgggttgccagccagcaccattcatcgactgcttggtttgaacggccgtgagtccaacgacaccactggtacgaaggatattgaaggggcactattaatcattgatgagatgtcgatggttgatacttacttgttcaggtcgttagttcgggcaattcccaaccatatgcaggtggttttggttggtgaccaggatcaattaccatcagtgggaccaggccaggtattccacgatttgctggtttctaagcagattccggccatgcagctgaatacaatttaccgccaggagaagggctcatcgattatccaattggctcacgatattcatcgggggcagctgtcggaaaatttcactcagaaccaatccgaccgctcgtttatcccatgtaacgagtaccagatctcttcggtcattgaacaggtcactaaacgtgccaagcaaaaagacttcggcttgatggacgtccaggttctggcaccgatgtatcgcggtcgagccggaattgacaggctaaatgacgtggttcaagaagtctggcagggtgatccaactggtaaaaagtcggttacgatcagagaacacacttatcgaattggcgacaaagtgctccagctggttaataaccctgaaaataacgtcttcaatggcgacattgggatcattgtggggatggacgcccctaaaggacagcaagttcccaataagattacgattgattttgatgagaccgaagtgacttatgagaagaatgagtggacccaattcaccttggcttactgcacgtcgattcataaagctcagggtagtgaattcaagatggtgattttaccaatcgttcggcagttctcccggatgcttcagcgcaacttactgtatacggccgtgacccgagccagcgactttttgattatgctgggtgaaaaagaggcctttgaacaatgtgtccgcaacgtatcggttaaccggcagaccagtttggtcaaacggctggtagatacaattggcattcagccgcaatcaaaaagcgctgacggagagccggaagctgaggatcaaaagcaattgccgactggcacgccatcagcccaagagactgatgatgctaaggccgataatctgcccgatcatttaaccacagcggttatcaatcaaaatctgattgacccgatgattggcatgggggatgtcactccccgcgatttcttgaagtcataggtttatcagtgaattcttaacaagttcaagccgaaattatggtagaatttaaataaataggtaaagaagaatacttggaggaaatcatggccgaatcaaaaacgcatcccaatcttaaattattttctttgaattccaaccgccacttggctgaggaaattagtaaagcagtcggtgtgccgcttggcaagtcaacagttgaaaagtttagcgatgacgaaattaaaattagcgtcgatgagagtattcgcggtgatgaagtttacatcatccaatccgtttctgatcccgttaattctaatttgatggaattattgattatggtggatgccgttcgtcgggcaagtgccaagtcaatcaacgtggtgattccttattatggctattcacgtgccgatcggaaagcgcgctccagagaaccaattactgccaaattagtcgcttcctttttagagatggatggcgttgatcgcgtggttgcccttgatctgcatgctgaccagatccaaggcttcttcaacattcctgttgaccatttgaaagccgatacgctgttggcagactattttgttaaaacccacaagagttccgatgttgttgtcgtttcaccggaccataccggtgtttcgcgtgcacgaaaattcgctgaacttctgagtgcgccgattgcgattattgacaaccggtcgccggaagatgccaccacggttcccgaatcagttatcgggaacgtgaagggcaaacgggcgattattgtcgacgacatgatcgatacggcatttaaattgacaattgctgccgaaaccttaaaaaaggccggcgcaaccgatgtctttgcgattgcaacccacgctgtcttttcaggggatgcccaacagcggcttcaggattcaccaatcaagaaggttattgtgacagattcaattagtatttccaaagctgaccaatttgaaaaactggaagtggtttccgtgggtcaattatttggtgaagccattaacttgattcataatcacaaatcggttggtaagctgtttggaagataaaatattttacgaggtggtttaatttatgtataaggcaaatgacgatcgttatgaaaacgcagtggtacgcagagctggaaattccgggctccaactgccggcactatcatttggattgtggcatagctttggcgatgacgccaactatggcgacagcgagaaagtcattttgaaggcctttgacttaggaatctttagctttgataatgcttataattacggcccaagtgccggtgctgctgagcggatgttcggtgaagtttaccgtgccaacctcaagccgtaccgcgatgagctggtgattaccactaaagccgggtttaatatgtggcccggaccttatgggaacttctcatcaaagaaaaccttggttaatgcgcttgacggcagtttgaagcggatgggcttggactatgtggatatctattacagccaccggtttgatcccaataccagccttgaagaaactgctgaagccttggatgagatcgttcgttccggaaaggcgctctacattgggatctccaactacaatgccgcccaaaccgctgaaattatcaaatatttcaaggaactccatacaccattcgttgtgaatcaggcatcttataatatgctcaaccgtggtattgaagaagatggtctgctggatacattgagccaaaataataaggcgctggtcgcatacgggccattggctgaaggcctcttgactgacaagtatttaggcggcatggatgataacgttaagattcactggagtaatgaatttgtcatcaaacatggtaaagacgagttggtgaagaaattaaatgagctcaatgacattgccaagaaccggaaccaaaatctggctcagatgtcattagcttggcttttgcacgatccaacggttgtcagcgtggttactggggcctcgaagattaatcatctggaagataacctgaaagcactcaacaatcttgactttacgtccgatgaattagctcagattgataaaatcgttaaagaataattattaggttgttcatacatgtttgaattaagcattaaattgggattaaaccggtttaatgctttttatttggtataatctaatcaaagacatttgtccgtgaatggagaataattatgacaaagaaagtgacaattactgatttagccgctcgtgcccaggtctcagtgacaacggtttcacaaattctcaatggtaaggctgcccgttttagcagtaagaccgttgagaaagttaagcagttgcaaaaggaaatgggctacgttcccgactttaacgcccaaagcttgattcgtaaaagcggtcggacaatcggtgtgatcattcccaacatgaataaccctttctttagcagatttttacttggcattgagactgaggcaattaaacaggactatgtgccccttatttttggctctaacaacagtcagtcacaagagacgcactatctcttcgaatctgttcgaagggccgcagacggcatgataatcgcttcagcggtgtccgacattaattatattgataatatcttgaatcaaaacggcattccctatattttaattgaccaggcaccggtggttaagggtgatcgggttgatgccaataatcaaaagggcggggctttactagccgattatttaatcaagaatggtcatactgatgttgcggttgtctgtgccaccaaaccaaccctcaatcttcaggaacggctggctggatttgtggaagcctacaaaaacaacggcaccccaattcctgaagaccgaattattacgactgagatgaccaaaaaagggggttacgctgctacgaaagcagcgttagccaccaagccaactgcgatttttgggatcaatgacgaggttgccattggggtctatcgtgggcttgaagaagccggcttgaaaattccaagtgacatttcggtggttggatatgatgacattgatttgggagagtacatttcccccaaactcaccaccgttcatcagcctgcttttgaaatgggaaccaacgccgctcaaatgatcatcaagcgaattgaagaccataatgagccaatccaacaggtttccctgccggtatccttggtagaaagagagagtgtccgggcaattaactaactgggatagttgttaaatttcaggaaatttgatagaatttggttaaaggttttaacacactatactaagggatttagaggagcttattatgacaaataaagtggttgtgctcggaagtctaaacgttgatacaacattgcacattgaccaaatgccaaaaccgggggaaacgattagtgccaagagtaaaaccaattccgctggcggtaaaggggccaatcaagcagtcgcagctgcccgttccggtgctcagacgagttttattgggcaagtgggtgatgatagcaacggcatctttatgatcgatgctttgaaacttgacggcattaataccgatcatgtgggtatcaatcaggtcgatgggaccgggtctgcggtcattcttctggacagccagggtcaaaacagcatcatggtttatggtggggctaaccaagccatgaaaaccgaagtcatcgccgacagccaagccctgattaaaagtgccgatattttaatttccgaatttgaaacgccccaggaagtcacctacgaagcgtttaagttggccaaacaacatggtgtgaccacgattttaaatccggcaccggcttcaaaaatcatttacgggttgctcgaagtcaccgatttgattgttcccaacgaaaccgaaagtgccacattgaccggtatcgaagtcaacgatactgattcaatggatcaaaatgccgctaaattcagcgagatgggtatcgataacttgatcattacggtgggcgatcgcggcgcgtactatcatactccaagcgacagtggctttgtgccggcattcaaagttaaggcaaaagacaccacggcagctggcgacacatttatcggggctttcagttcacaaattaaccaagatttatccaatattgaagcagctttggtttatgctcaaaaggcttcatccattacagttcaacgtttaggggccttaccttccattcccacggccgaagaaatcaaagcggaatacaaataaaaattatcttaaaaaatcttaattaactatttttaatggtaaaacggcgtttcttattgcttgatgaccgtctgtcagaatgcttacggtcgttactgccttcataatggccccgatttcggctgccattattccggtcgccattacgatgactctttgagcccttgtaatgaccaccatgaccgccaccacgacgatcgttgcgatgaccaccgtgtccatgaccatgatgtggtaatgggcgttcaggggtaatcttaaccttaacgttgtcgcgagtaacgtcgttgagcagagcagcaaccaaatcagttgcttcatactcgtcgagcagcttgtcagccatcttctcatacttgtcagtattcgtcttcttaattaagtcggcaatatctgattcagcagaattcaattgaccaacaaaggcttcttgaattgttggtggcttcaaaggcagcatacgcaccttggtcaacttttcgatttctcgaagataatccatttcattaggcgttgcaaaggtaattgaaaccccatgcttaccggcacggccggtacgaccaacacgatggacgtagccatcaggatcttgaggaatatcgtagttataaacgtgggtcacacctgaaatatcaattccacgggcagcaacatcagtggcaactaagatatcaatcttggcagctttgaattcctgcatgatctgagtccgacgagcctgagtcagatctccgtgaagaccggcagccttgtagccacgggcctggagtcctttggagacttcatcaacccgacgcttagtccgacagaagacaatggtgacttctggatcctgaacgtcaaagaaacgggtcatggtgtcaaatttttcgtattcttttacccgaacatagtactgatcaattaaatcagtggttaattctttagccttaatcgttacttgatgagggtcacgcataaactgaaccccaacccgtttgatttgggcaggcatcgttgctgagaaaagcaaagtttgacgttcctttggggtttgtgtgatgatatcttcaatatcgtctaaaaatcccatgttcaacatctcatcagcttcatccaacactaatgtcttaacgtgctctaactttaaagtatggcgtctaatatgatcaagaattcggcccggagttccaaccacaatctgtggatgaccctttaaggcgttgatttgacggcgaatatctgcaccaccataaacaacttgaaccttagctttttcatcttttcctaatcgatagatttcttcttgtgtctggattgccagctcccgagttggtgaaatgatcagagcttggacatttggattgtcaaaatcaatcttctgtaagattggtaaaccaaatgcggcagtttttccagttccagtttgagcttgaccgataacatcctcacctttaagaaccattgggatggtttcgccctggattggcgtagcttcttcaaacccactgttattaatcgcagttaataagtggtctgataatcctaattcactaaacttcaaatatgtttcctcctaatattgaaacaatcaaggttccgcggccgactggggaaaaatccgtttcccggaatgcgttgaccacttgacctacaatcatttattacaaaataacctttttagtttacaccgtcacataacattaagcaagcaatacaggccaactcgtctgttgaccgtgcttatttaaccagtttggcaacaacattttccaaatgcagaccgtgactggccttcaacaagacctcatcgtcagcgctcaattcggcttgaagatcagaggtcaattcatcaagctgatcagcttggtaatagtggagattctctggggcatagaccggcttgagtttctcatataaggcgtccatatcggcgccaatcaggtacaccaccggaatggaggccggatccagggcatccgctagcgaagcgtgcatcgcttttgattgagtcccaagctccaacatgtcgcctaaaacagcaatccgtcgccccttggttgtcgtgttcttaaaagcggtcaacacttctttagcggcggtggggttagaattatagacgtcacttaaaattcgctcgccctttgaaccactcaaccactgggtccgattcttagtcagatcaaatttagccaacttgtcagccatcatctgcggatggattcggaaaattcggccaaccgaaatggccgccagggcattgttgacgttataatcaccgatcatcggaatcgtaaaatcaatctccggccacaaattgacgtgaaattgcgtctgatactgaccatctttggagtcgatggcaaaaacatcattgctgtcttttctgccaaaagtcgctttgatcacactctcatccacttgttgggcacgctctgtgagcagcggctcgtcgccgtcatagacgaagaagccgtcagctttcagaccatgagtgatctccattttggcgtcggcaatcttatcacgggtgccaaagaactcaatatgggcttcaccaatcatggtaataacggctacatcgggccgagccagtttggatagaaaatctagttgcccgggtcgatccatccccatttccgccactaaaaactcggtattggattccatctgcagaatcgtataaggcaggccaatctcattattaaaattgtcctgggttttggtgacattaaacgtactggataaaattgcggcgatcatatctttggtggtcgtcttgccgttgcttccggtgacggcaatgacgcgtggattaatcttatcaagataatatttgctgagctgttgaaatgctgtcagtggatcgtcaacaaccagtgccggaattgttagtggtaagcgatccgcgtggtcactggcccaaagggtagctgaggcgccgcccgcaattgcattgtcgatgtaatcgtggccgtcatgttctgcaaccagcggaacaaacagttgaccagcttgaatcttccggctgtcaaagcacaccccggtcaaagattcgtccagcattgctttgtcaaaattttcagtgttggcattaattgcttgagcaacttcgccaatcgtcattttcattattgaacgctccaattgttaaatagttatgttcaattataacaaaaaatcaaacggctaaacacccaccgtttgatcctgccattctaaatgccattttgatgtttgtaaattataggtcaagtccccggcatagacggtattttcatcgactttaccggttggcaaaataattgaaacctgatccgggtccttcaaaatccgtaatggaatatgataagtccgggaacgttcccgcaaggaatcaaaggaaataaacaggccgtcgttagctttggtaatcaaatccaagagaatcgagcggtcaatgtctttgatcgccaatggacgcaggaagactctcaaagtgttatgggtctctcgcaaattgcgcttaatggcgatttccaagacgtggttaaagtctgagaaacgccggtaatatgaacgaatcgttccgttgtcttgactcaaataaatgtaatgattgttcaatttggaagaaaaaggccgacccattggcgttcccatgtgggccagatacaacagttccgcaatttcaaatggtgacaagttgttaacactgtcttccacgtcaaaatcaataaacttcttcttttggtcgggattacggaggagataggtccgaatttcacctgtgccattgatcagattgaacttggaatgagagttgtacccgttagcagcctgatcatcattatttaacaaaatgatattttgaggcaattcatccagtccattaataaaatcggccgcagtgatccctgatgataaaatcatgttggagattggattcgtatttataaaaatcaaattgcccttcatcgtttcattaccccgtatttatatctaaactaattgtactaccctcacgtttagctgtcttataattaagacagaaatgtcgtaatttgcccttttcttaattcattggtaacatggtggttaacgcaatattagtgtgaggttattaatatgactaacgtattatttgtttgtctgggaaatatctgccgttcgcccatggctgaggtcatgttccgtcaaatggtgaaggatgcccatttggaaaatcaaattaccgttgcttctgcagcgattagtaccgaagagcatggcaatccgcctcatccaggtgcgattgccgaattagccaaacacggcttgtccgtcggcaataaaacgtcgacgcccatcaccaaagaagactttgatcaggctgattacattattgccatggataatcaaaatatcttttatctcaatcaaatggccccaattgccgatcggaaaaagattttcctttgctacaacattattcccgacaagcagggaaaagatatcccggacccctggtttgaccacaaatttggccgaacttaccgtcagttatcagaaaccctgcacgaatggttggataaaatgaaaagccaattggcttaattattgacgggtcccaataaggctcgttttaattttggtgtcgcatgactgattcgataacttttttggagtttaccgcgaatcatcaagcgtcccgcgccggtcgcgtcacaggtgatcaacgtgacaatcggccgcttggtttggcggacaacgtcaacccgggtcgctgcgataaacttgcgctggtaaaccttgtattgatagactttggtcatattactgagatagatccgatcaccaacttgggttttgaagtacagcgggccaaataaaacgtggcggttaaccatgtggtgccctgccaacggatagttgcccttgcccatctgctggtcaggccgcatggtcccggcagctagcgccaaggtattattagccactcccaacccaattggcaaatgaatatgtgatttgggcaggagaatttcgccgataacttcaatggcgttggtgttcatccgcgcccgagcagcagtttgaaaatcaagggatttgacttttttaaaatcataactgacattttgcttgtgacgcttagtttgtgctttttgccgccgttcagttttggcaacggtctggcgggtgatttttggctgataagatttgatcaattcatttttgattggccgattaaaaatcatccccaaagcgacaattatcaacaacacaaaaaccacgttaatcaatattttcttgagaagtccttttctcataactacctccactcaacaacgaattataatatgtacaaaataataaaggaggaacctcattgttaacaaaacaagttggtccaaactcctggcggcgcaatttagccgttctctggtttggaaccttcatggccggaatcggcttcagcgaagtgatgccatttctgtctctatacgttgattcgctggggcatttcacccataacgaattgagcctctacagtggattggcctttgcggccagttacctagtgaccgcgattgcttcgccactgtggggaaaattggctgatcgaaccggccgaaaattgatgttggtccgagcatccgccggaatggccattgtcttcattttgatgggattggtcaccaacgtctggcaattaattggccttcggctcctgcagggtgtcttttccggatacatcagcaatgccaacgccctgattgccacccaggtgccgaaacgcaaaagcggccaggccctcggcactttggtaaccggtaacgtgtccggtgccctgctcggcccgctgttaggcggaactttggcctcattcttcagctatcgggtcacattctttattaccggcgccctgtttgtcggtgtcttcctggtaacgacgttgatggtccacgaagatttcaaaccagtcgccaagtcgaaaatgctcaacacgcgtggcgtaattggtgaactggccaattcaaagctggtacttgggatgtttgttaccaccatgattattcaagcggctaacaactccatcgttccaattttagcattatatgtccgccaaatcatgaataatagcccggcgaccaccttctatagcggaattgtcgctgcggtccccggcattgccaccttggcagctgctccgatgttgggacggctgggcgatcggattggtgctgatcgcgtcttgctggtcggttttctgctggcaatcgttgtctacgttccaatggcatttgtcactaacgtctggcaattgattggtcttcggttcctgatcggcgtcgccaacgcgtcaatgttacccgctgtccagtcgattctggctaagaacaccccacctcacgttaccggccgtgtgtttagctggaaccagtctttccaagcgatgggcaacgtggctggtccaatgattggatcagtcgtctcgacctcatttgattacgcaggtgttttcatttcaactgccgtcctggtagtcattaacctcaccttagtattcaacaatacgcggggaatgcgccgagcacgcaaacaacggattgaataaacccgtttaccaattagtatgagaacgaaaaataggagttggacagtcagtatcgcttgtccaacccctatttgtttgcataaaaaacggggaaccgttaagctcctcgtcttcgtcatgcttatttgttgtctgtaagaccgtatttcttgttgaaacgatctacggcaccatctacttgattgaacttttgcttaccagtgtagaatgggtgtgaatctgatgaaatttcaacacggatcaatgggtaagtcttgccatcgtccatcttgatcgtttcgtcagaggttttagttgatcctgagatgaacttgaaacctgtagatgaatcttgaaatacaacttgttgatatgctggatgaattccttttttcattatatatcgctcctttgccctgaatcaatccgatgacccagagattatcgattagtcaactttgttagtgtaccataaataaaatcgtcaatcaatcatcaattgactctttcttcaacttctaatttaacgtcggcacccacaccccgcagcttatcaacgatgtttccatagccgcggaggatgttgtcggcatggcagatttccgtggtgccatccgccatcagcccggcaatcactaacgacgcgccggcacggatttcacctgcctgaactttggcacccattagcttgggggagttatcaactacaatgatgccttcatcggtatcctctgatttgactttaccgcccaatttattcagttctgtaatgtgcttaatccgtttgggataaatggtgtcaatgatcacactgcgcccctttgccttaaataatagcggcgtcaatggctgctgaagatcagtggcaaacccaggataaggcatcaccttaattcggattggcttcaagtcatgtgatggtccgacataaatgctgtcctcataaaccgttaagtcgcagcccatctcttctaatttggcgacaaaagcttccaaatgttcggggatgatgttggtgattaaaatcccatcccccacagctgcagcgagtgacaaataagtgccggcttcgattcgatcaggaataattgtatgagtattacgagcctgaagggttggcacgccttcaattcgaatgacatcggtcccggcaccacgaatattggcacccatgttgttcaagaatgtcgcaatgtcaataatttcaggttccttagccgcgttgccaataacggtggttccaggcgccttgaccgacgccaaaattgtattgatagtcgcacccacagaaacgatgtctaagaaaatctgggcaccatgcaggccatccgggccggtcttaatggtcactgtcccatcgtgttcactgacttcagctcctaaagccttaaatgccttgatatgctggtcaattggccgcggcccgatattatcgccaccgggaaaactaacggtagcacgctgaaaacgacctaacagagcgcccataaagtagtaggaggcccgcaagcttttaatcgccttgcttggcagtggtgcctcgacaatattggtcggatcaattgttaggacatcgcctttgaactcagacgaaacgttcatcgattttaaaattaacattaagttgtgaacatctaaaatgtctgggaccgagtcgaacctaacgggggtatccgctaatatggcagcagggataagcgcaaccgtgctgtttttagcaccgccgatcgatatctctccggacagccgtttccctccatttatgattagtttactcatcaaaaattcctcactttttgtattcgcacatttttcatgtcaagaaatatattatccaatatccacacaaaaaacaatacctatacttgaattatacaatctgtaacaattaaaacaattgttccgtacaaacgttttcatttaatgagtgctagtcgggctaatttgacgccgttttcagcgaattattacaagacaaaatgagcacctgtttgcagtaatcgataaccagcgaacccgaaagcgcttttaaaatccaacaattcagtcggtttgtttcatcactcaacaaatggtcagatctacttctttaactatccctgaaagtccttagactattcaggcatacagaaaaaaggagcggttagaaatgaaacgactatttacgacaattggcgaaaatattcatcggcaccacaaactttggatcacggtcatcttgatcatgaccatcggttttgcatttggattgccaaagattcaaatgaaaatgggcaacgacgtcttcgttagttccagttcaaaaacctatcaggattcccaaacctatcagaaaaagtttggtggtgactccctttatctgttgctcgacggtaaccagtcgacattgttatcccacaagacaatgcagcaggtggccaaatttgacagtaaagtcagccaagttgataacgtcagaaatacgaccgacatcgtcagtagtttaaatgatcagctatcccatgccggaactggaaactccagtgcccagttcaacttcaatagcaaaaagcttcaacaagatctgatggctgaactgagttccaaacaaaaacaaaacattcagtcgaaaatgcaacactcgttaacaagtacgcaacaaaatcaggttcaaacatatttgctgaaacaactcacgcccgcccaaaagaagctgatggcagcagctggtgcccaggcgcagggttccaagcaacagcagcaagcaatgcttcaaaagcaattgaccaccaaacagcaagctgcagtccagtcctacaccatgtcgctgcttaaccatcagcagcaatcacaattggctgacacggtcatcccgatgctgccgaaagttcaagacatgtcaaccaaactgctgcgggatatttttctcagcgataacggtcatgttccaagtgcgatgaagcaattattacctaaggacggcaagcatctattaatcattatcaacaccaataagaaatcgtcggatatgaacaccgcggttcagattaatcacgacgctaatcaggcaattaagcaaaccaacttttcctcaagcattaagacccgattgggcggccaacctgcagttcttggtcaggtccgcagtaaagtcattaccagtatggcaaccatgttggcattcgcagtagtcttaatggtgatcatcctcctattgatattcccggtacgaaagcgtttgttgccactcatatttgtcctggcctgcctcgtatggacatttggtttgatgggttggcttcacattccgttgaccttggcaaccatggcaacgttgccgattatcattggtttggggactgactttggtgttcaatttcaaaaccgatatgaagaagaagtcaggaaacgacaaaattcccaggaggccatttcagttgccatttcgagcatgggaccggcagttggcgtgtctttaatcgtcatggtcttcagctttttgacgatgtatctctcaaaggcgccattgatgcagcaatttggcctcacgttggccattggtgttgcctgcagctacgtcgttgagtttggactgatgttttcaagcctctcactcttggataaacacgcttcaacagctaagttggcacccaagaagctatctcagccgtcgcgtttatcactgttcctaagtcactatgctgaatgggtaacccatcatgcaggtattctgctgacaattggcgtggtgttggctggactaggtttttcatttgaaaaatccatcaatattgaaactgacttcaccaaaatgattccccaaaatatgacggccctgaagaataccaaatatcttcagagcaaaattgggtcgacaacctaccttacctatttggtagagggcaatggtcgagatatcagggatcaggacaatttgaagacaatcgatcaagttggtcaaaaagtggaccataagtaccatgacgtcaccgatgtcaccagcttatcgaccgcctatcaacagacgaacggctcattgaacacttctcaaaagcagttaactgtgggtgttgacaatttggcaacgtctttaaaacaaactttgattagcagcaaccatcacgatgcaacaatccaattcaaaattagaaacggtctgtcctcaaaagaacaacttaagttgatgaatcggattaatcatgacattaaaggaacccatcatggcttaaaaatttctcctgcaggagcccaagtcatgatgctattggggattaataatatgtccgctaatcatgatctgattattattgccggtctttcgatcattttcattgtcctattccttatttatcgggactggcgactcgcactgtacccagtcattccaattttacttgtattaggactttctccattaaccttaaaactgttgggaatttcctataacccggtcacaattgccctcagttcgctggttcttggaattggaaccgaatttaccatcttaattctggaacgctaccgcgaggaattacaacggggaattagtacccgggacgcgattgtttcagcaaccgcgtctgtcggtcaggcaattacagtttccggcttcacggtcatgggcggattttcggccatcatgttctccagcttcccagttctgaagtcatttgggctgattactgtgctggacacaggttattcactcatctgtgcattgacgattttgccggcagtcatttatctgctgcgaaaaagaaagccggcagccactcaatcctcatccgaacaggcaactgaaagtaaggattaattgaccgattgaaatacccttttctaactaaaaaatggcttccataaatgaaattgattcatttgtggaagccatttttgtgttttgcgctgtttcttggcatctttgcgccatcaatcagccgccttaattactgggcatttagtttattgatgatcgaaatgagaaacgactccaactgcggccaatcaatattcgccttgagaagctgctcttctaaaaagcccattattgtattcgctaaaaaactgatcatcagcggttgtgaagacgattgcttaattaacgttacgacaggatcattttgataggctggattgttggcccgctcgttaaacaagttctccaaaatgttccgaaattcatcatagaacttactttggctttcgggaatcaggtgacgaattaaatcaatgttgtcggaaataaaatgggtaacttgggttaaaacaacggtttccctgaagtcggtccccagcaattcttcagacaggttatagataattgtatttgccagatcaaccttatcttggaaatatcggtagaacgtgctgcggtggatcatcgcttcatcacagatttctccgatcgtaatatcatcaaatttcttttttctaagaagcgtcatcattgcctgcaaaatatctcgcttggtgcgctgttgagattgggtgtcggccataatcaaagtcctttcaaaatttagattataaaattaagcatacatcataaccaactattcttaaagaaaccaatgacaactttcacaaatttgctgccaacaaaaaagccccgacccaccatgggatcagagcttcacttgaattgttaaccgtcaatcagattcaccctaaaagtgcatcgtcagttacagacggtttagttatttttttcaagatacagatcatttgccgcagcaacgaagtccttgaagagcccttctggacggttgggacgggaaataaactctggatggtactgtgaaccaacaaagaaccggttctttggaatttccaccacttcaaccaagtgattgtcaggtgaagtcccagaaatgaccatgccatttttctccattgcgtcccggtaggcgttattaaattcgtaacggtgacggtgacgttctgagatgacgtcggcattatcgtaagccttggcagcaaccgttcccggctttaatttacatggataagcgcctaaacgttgagtgccgcccatatcgtgaacatcttcctggtcagccatcagatcaatcacattgtgtttggtccgcggattcatttcagtcgagttggcatctgggtaggacagaacgtcacgggcgaattcaacacaggccatctgcatccccaggcaaacacccagatatggaatgtcttgttcacgcacatatttgatggccgtaatcatgccttcaattccgcgatcgccaaacccgccgggaacaatcaccccatcggcatctgacagcaagtcggcaacgttatccggcgtaatcttttcagaatcaagcatctccaaatcaatgtcggcgtcgacaacgtagccggcatgtttcagtgcttcggcaacagaaatgtaagcatcttggaggccaacatacttcccaaccagggtgatatgaatcgtccgtttgagatgttgaacgtgatgctcaagctgcttccattcagtcatgtcagcagctggcttatcaatgccaaagtgatcgaggatctgttgatccatcccctgcttttgcaggttcaacggaatcgtgtacaaggttggcacatcaagtgattcaaccaccgcctgcggcttaacatcacagaacagtgaaatctttttgcgcattgagtcggtaattggcttttcggaacgaacaaccaacagattaggttgaatgcccaaaccacgaagttccttgacactgtgttgtgtcggcttggtcttcatttcaccagccgctctcagataaggaatcaaagttgtatgaacgtagaacacgttttcgtcgccaacttcagtcttcatttggcgaattgcttccaggaatggcagtgattcaatatcaccaaccgtcccaccaatttcggtgatgacaatttcagcatccgaaaccttggcagcccgcataatcttttctttaatcatcccggtaatgtgaggaataacctgaacggttgctccaagataatcaccatgacgctcttttcttaggacttcatcataaatcttaccagtcgtcacgttggagtatttattgaggttgttgtcaataaaccgttcataatggccaagatccaggtcggtttccgtgccatcgttggttacgaaaacctctccgtgttggtagggattcatcgtgcctgggtcaacgttgatatagggatcaaacttttggatagtcacattcaacccgcgatttttcaacaatcggcctagtgatgccgcaacaattccttttcctaaggaagaaacaacgccaccagtaacaaaaatatatttggtcattatataatcctctcctcttgatagttagcctgggaattcaaaaataaaaaaatccctatccaaaaaagtgaatagggaacaattcaatcatcgttcagatgtccttgaaactcaaggagcccaaaaaacataatacatactttttaaatattagtcaagaattaatggtcgtcttttgaattgaaatcatcatcgtcatcatccaatgaatcgtcatcatcattcaattcgttaagttgaccttcgataccatctggcaagtcctcatcgtctgagtcatcgtcaatatcctgcaagtccttgttgtacttgccaagatcttctgattcatcatctgaatcgtcgtcatcgtcggtatcgtcatcaaagtcatcgtcgtcctgatcttcaggatcatcgtcatcgtaatcgatcacgtcgtcatcatctgaagcgtcggcaagaaaggcattcaccttacgacgcttctttcgcttgggacgatcctcgtcttcttctgtatggacagttgcttcatcaattgattcataagggtaccatgttcgtaagccccaaagattgtcaccaagtgagataaagctgccatcaatgttcaaatcggtataaaattgtgataaacgatcacgaatttctttgttactatcacctaaataagcctgcaccgcattggctaaatcggcaaatggcattgtgtctccacgttgtgccaagattgcgtgtgcgacctcaatcatcgatagttcatttttgttttggcctttaaagacttctaactccaaactggtacacgtcctttcaacagtctaacaacagtctaaaaattactatactcgattaaattgtaaattgcaatcgaatattgtatttccctaataatgcatcgccggcatacagcaaataatcaattccgatgttgccccgaagcggtgcatctaaaatttccatgtccaaagcagaagtaacggtttgaatatccatcaagccatatggggttcgatagcgggcagcaatccgtttgccgtcgctaaacaataattgcagtcgattctcacctgagcgggtcagtttgacattaccgttatctgaaattttaatggtgaccggaaccccgccatcctcagtttcctcttcataccgaatatacaggctgctgcctacacgaactaattggccggtgacatcaaaaacaaagtttgatttctggccttcctgtaaaatgttggtttccaaatgaatttgaactggaacgccagttgttaaattgtccataatacaccttcttttaaatctcgttctaactaatttattatatatcccacggcaacattttgcactcatgttaccctgacgatttccggcaactttacctatttatttggtagtgtctgttataattaagaagattgtttattttatgaaacggagagttggcatatgtcttttacaaacgttccgattaccgtcatcaatcaaatttattctaaaagcaccaagctggatgcctttgcagacaccaatgccttattggaaatctgtgaccaaacgttgaagccgttcatccatttttggacgacttccgaagcaactttgatcttggggatcaatgaccgccacctgccgaagctggccgacgggctcaaaagtctgctggccaaccactatgattattttctgcgcaattccggtggcctagctgtcgtcagtgatccgggaatcctcaatatttccctgttcattccccaaccggataccgtctacacaatcgatcaggcatatgaactcattaaagggttgatcagtatgtcgtttccacaactggacatcaagagttttgaagtcacaaactcctattgtcccgggaaatacgatttgtcggtcaacgggcaaaagattgccggcatcgcgcaacgacggacaaccaatgcgctggttttgatgctttatctgagtgttaatggcgatcaagatgccagaagccaaacggttgctgaattttatgaaactgccgatgcttattcgcagtctcgttggacctttccaaaagtcgacaaggccacgatgaccacggttcaagatctcggcttcccaaatatcacgctcgaggacgtcgaacataaatttttagcgagcgttaaccagcaaaatatcgaagttgacgtaaccagcggtcctgattttatgctttcaccggctttcactcaagagcgggccaaacagttacgcaaaattcagctgagaaatgaccaattaccaattgtctaaggaggcaattttttggattacgcacatcaacagttaaaaagagaaaaggtctttcgagatccggttcataattacgtttacgtcaaatatcaagtcatcttagacttgattaacaccaccgaattccagcgcttacgtcgggtacatcaattgggaaccacgtcactgattttccatggtgcggagcattcccgtttttcgcattcggtgggagtttatgaaattgctcgaagaatcattgaatcttttcaaaagaactttatgtcacaacaacctggcgatggtctctgggatgattcagaaaaattagtcgccctctgtgctgccctgttgcacgacgttggccatggtgcctattcacacacctttgagcacatctttggcaccaatcatgaacagattacccaagccatcataacatcgcccacaacggaaattaaccaggttttacgaagggtctctcctgacttccccgaaaaagtcgccagtgtgattaacaagacctatcccaacaaacaagtcgtcgaaatgatctccagccaattggatgccgatcggatggattacctgcttcgagacgcttataacaccggcgttaaatatggcacgtttgacctttccagaattctggaagtgatgcggccgtacaaagatggaatttgctttgaaatgagcgggatgcacgccgttgaagattacattgtcagtcgctttcaaatgtaccaacaggtgtatttccatccggtttcccgggcaatggaagtggttttgaaccggttgttgcaacgggcaaaagttatctttagcggggaggttcatcacgatccacagaccccctacctattactgccgtttttcaagggtgattttaacctggacgactatctccaattggatgacggggtgttaaacacctacttcatccattggaaacggtacccggatgatattttaagcaacctggccagccgttttatcgaccgaaagccactcaagtcagtcaaatttgacaagtcgaccgccgacttgttgccaagactcagagagattatcgaacaatctggatttaacccggactactacacggcgaccgacaacagttttgacttgccttatgatgcctatcaggcggacaaaaaacaaattcatttaatgcaggatgacggtaccttggtatccttgtcatccgttagcccattggttcgggcaatttctgatcgacagaccggcgataaccgcttcttcttccccagagagattttgaagccggatgaaaacgtcgatttgttccagccagaatacgatgaatttaatcgccatattcgaaacgacaaattaattaaatagctaaaggagattctcccatggatatcaaactcattgccatcgatattgacggcacccttttgaacgaaaaaaacgaactggcgcaaccaacgattgacgcgatcactgaagcccgcaataacggcgttaaaatcgtcttgtgtaccggccgaccgctcagcggagtacagccctatttagataagctagccatcaagggtgccagtgaatttgcgattacctttaacggcgcaatggcacaatcgcttgacggtcaagtcatggtcaatcacacgatcagctatgataacttcttggagaccgagatgctcagccgcaaattgaacgtcaattatcaaattgagacaaccgacagcatctataccaccaaccgcgacaccaacccctatggaatcgccgaaagcttcctggttcgcctgcccatcaaattcagatcaccagaagaaattccgcgtgacctggtgatgtcaaaggcaatgtttgtggactacccggaaaatatcactaaagccaatgacctcattcccgccaagctgcgtgatgagatgtacgtggttcaaacggaaccgttcttcattgaaatgatgaataagcaggctagcaaaggaaaaaccttaggtgaattagctgatcagctacatttaaccaaagataacctgatggcgattggcgatcaggggaatgatttaaccatggtaaaagctgccggcttgggagttgcaatgggaaacgcaattgatgaagtcaaagatgcagcccaatttattaccaaaccaaatacagaagatggcgttgcatttgccatcaacaaatacatcaaccattaatggctgagtatacgaatagaggctatgaacaaaacgttggttttgtccatagcctctttatttgtatcaatatctgttattatccttgccaagtacaatcaacaactcagcatcaaattgttcaccgcttattggggcaaactggtgaggatgacccctaacacaatcaaaaagccacccacgcccaggcaatagcgggcgtatttattaactttgattggctgatttttaattgaaccgacatcctttgccttgggatgcttgggatcattttcagcttccaagtcgcttttcttgcgaatatggaatcgccaaccggtaaataggtgccccgagccgacgataaagaccgatcccaaaacaatcaggaacaatccaaccaaaaaatcaaggttaccaagcaccatttccggcattcggaaaagaatcagcaaaaaattgatgatcacaacaacaataatcgaagaccaaaccggcgattttttaaccaaatcgaccattaattctcttcaccacgaaatcgattgttgaacagcggactaaccggtttgttttcattgatgcgtttaattgcatccccaattaacggtccaactgagacctgttcaatcttatcgatttgtttttctttgggtaactgaatcgtatcagtcacaaccagttgtttgattgcagaatcttgaatccgctgaatggctgggcctgaaagcaccgggtgggtacagcaggcgtaaacctcgctggcaccggcatccattaatgcctgagcacctaaggtaattgtgccggcagtatcgatcatgtcatcaatcatcaaacaacgcttgcctttgacatccccgataatattcatgatctcggcaacgttggcccgtggacggcgtttgtcaataatggcaattggtgccttcaagaattccgccagagctctggctcttgatacaccaccatggtcaggcgatactacgacatcatcactgccaaagccttgcttaataaagtgatcagctagtaatggagcacccattaaatgatcaacgggaatatcgaagaaaccttgaatctgagcagcatgcaaatcaagggcaactacccgatccacaccatcggtctgtaacatgtttgccactaatttagcggtaattggttctcgtgaacgggctttgcgatcttgacgagcgtaaccatagtatggaatgacaacgttaatcgtgccggcacttgctcgccgcaaggcatccaccatgatgagcaattccatcagattgtcattcaccggtgcggacgttgactggataatgaaaatattgtcgccacggatactttcgtcaatattgatgcggatttcaccatcactaaatcggtcaaccgaggtcttgcctaatggaacaccaaccgtttccgcgattttctcagccaaaggccgattggaattcaaagcaaagatctttagtttcgaatcaaaatattgctgagccatatgatcctccaatatgttttttgttaactcacatctcaataacttaattatacaatgttttaattaaaattcagagttaatctttctgataaggcaattttttgaaatagccggctttatttgtctggcgggcacgggcaatcgccatgtcgtattgattaactgtcttattaatggtggatccggcagcgataaatgaatggtcagcgacttccagcggcgcaatcaaattcgagttgctgccgatgaaggagtcgtcaccaacggttgtttcatgtttgtgagcaccatcgtagttggcgaagatgaccccgcagccgacattgatattcttgccaagtttggcattaccaacgtaggttaagtggccgactttggttccctcgccaatcgatgacttcttgatttcaacaaagttacccaaatgaacgtgcttgccgattttggcttctggacgtaaatgactgtttggcccgatgtctgagtgatccatcatttcagattcttcaattagtgaagatgtcaccgtgacgtgatcatgcaggattgagtcgcgaatttcggagttggcgccaatgtagcagtcattgccaatgacggtgtggccctttaattggacgccgggttcgatgattgtatccgaacagattttgacatcggcatcaatatacgtgtgttccggatcaatcattgaaatgccgtccatcatatgttgacggttaatccgtgtccgcatgatctcggtagctctggctaaggcaatccggtcattaacgcccattgactcgtcaaaatcatccatcttgtaggcagcgatggtttcgccctcagacttcaaaatttcaatgacatcggtgaggtaatattcaccctgagcattgtcattggtgagcttatgtagtgcctcgaataatgcctgattgtcaaaaacatacacaccggtattaatctcatcaattgcttgttcttctctagtagcgtctttttgctcgacaattttttcaacaatccccaaatcattgcggacaatccggccatacccggttggatcaggggcttgagacgtcaaaattgtcgctttggcttttttgttttggtggtaggtaaataaatcttcaaaagtcttggttgtcaataacggggtgtcaccactgacgaccatcgtcatcccatccaagttgcctaatagtttttccgcctgcaaaacggcgtgcccggtcccgagttgtttttcctgaacgacatattgcgttcgcttaccaaggttttcccggacggcgtcggcaccaaagccaactaccgttacaacgttatccatatcagctttttcgacggcggttaaaacgtgatcaaccatcgttttgccgcagaggcggtgaaggaccttgtaaagtttggatttcatccgggtccccttaccggctgccaatatgattgtgttttttgttgccattatctatttctccccaatgcttaattaaatattttttcgatatagtttccaggttgtgaaacaaccgtgttattctcagcgtcaactcgcatcaatgacgtgtagtcgccgatcgtccggccgtttggtgccgtactttctgccacaacgccgacaccgatcagattggcgtcaaactcttcgaccatcgaaatcatgccaccgaccgttccgccgccacgcatgtaatcatcaacgattaaaacgtttgaatcgggtttcagacttcgcttggatagcgacatcttttcaattcgggtggatgatccggacacatagttgacgttgacggttgagccttcggtgatttcagtatcgtgtctgacaatgacaaacggcacgtttagaaaatccgcaacactctgggcgattggcacccctttagtggcgatggtcataacggcatcaacattttggttcaggtactgagtcgcaaaaattcgaccgatttctcttagagtcgctggacttcccagcaggtcggacatgtagacatacccacccggaagataacgggtgtcagaagacatctccgcaattaatttgttgacgacctcttgggcctcttctttaagaatatacggcaaaaacctggtcccaccagcggcaccaggaatcgtttcaagcagaccggtcccccggttctgaaatgttcgttttaaaattgttaagtcttcactaatcgaggacttggctgaatcgtaacgatccgcaaaaaaggtcaacggcacaagtgtgtgtggccgctccaataaataacgggtcatatcgatcagtcgatcacttcttcttactttcaaaaattccacctcgagtttatgtaatatctatttgattttatcataaatgttcgtctttcggggaagatatagcaaaatataatcacagtttaaacttagcggcttttgttggcaattgaattataaatcaacgccgatccatagatggccgcttcgatgctggcaataaagaacgtgaccggccaattcgtgacgtaacccagataaaggccaaaccaaacgccaaagattgcaaagccaattgccaaaagcatcatctggattacggtgtgggcaaagtacttcgaactggcagccggtaatgtcaacagaacaaagatcaaaagcgaaccgacaatctgtgcggcaacactcacgctgaatgccaataagaccagaaaaataattgaaatcaaagagctgtgaatgtggttggttttggcaccaaccgcatcaaaagagtcatccttaagatttctaaaaataaaaaagagcacaaccagtactataacagacagggccgccatttgaacaacctcttggtgactgatgccgatcacactcccaaataaaatgttggtcgcgtaactggaatttttgttggataacgataaaaacaagatccccagcccaatgaaaagtcccgaaatggcactgatcaccgactctcgacgggattccaccgcgccgctgagttcgccaaccaaaatcgaactgactgtggtaaacgctagcatgccgtttaatggtgtccagccaatgaagattccaaaggctgccccggcaaatccaatctccgacagcgtatgggtcataaagggcatgttgcgggcaacaacgaagacacccataatcccgctgacaatcgcgattaaagtgccggccaggtacgcgttacgcataaattcaaaactaaacatattcgccctccttagaatcattatgcagctcactgattggcccagcagtgtatccgttcttagtcagccacaggaaatgatccggatattcatgaatgacctgcatgtcatgagagacgaagataatcgtcagtcccaaagtttgattgagccgcttaaccacatcaagtaactcccgcttagtgttgggatcaaggctggccgtagattcatccaaaatcaacaggtcgggatcattaatcagtgcctgtgccagataagctttctgcttttctcccccggacgccaatcctaatggccgtttggaaatgtgctcaagattaacctgcttgataacgatttgaattttttgcttttcttttcgcgacagccagggcaatttaataccggtgaaattaagcgagataaagtcttcaatggacaatggatactcgacatcaacgttacgaaattgtggcacgtagccaatttttaaaccggcttttagcttgatccggcctgctgaaggcttcaactgattcaagataaccctgaccaaggtggtcttgcccaccccattttcaccaatcacgccaagaaactcaccccgatgaaccgcaaaggttaagtcagaaagcacttggtgattggggaaacttaatgataaatcttcaaccgaaattaatgtttcactcaaatggaaatccctccacaactttgtaaaaagtaattattactattttagtttagattaaattgaatttttgtcaatcgctgttggcaaattaaaaggactgcttgaacaaaacttaagctttgtcggcagcccgttctgatttctttaaatgaccggatgtgaatcgcattccggttgggaaatgtaggcttcattacagaagccggaaatactattgtaaacgcggcgagcgcgggattcagttcggcagatgccaaaaacggtcggtccgctgccgctcatttgggagccgtcggcaccatattcaatcaaccgcgatttgagcgttttaatttggggatgaccagcagttgtaatctcttccaatgagttgccaatgtttgccacaatgcggtcataatcctgattttcaatgcctgctaataattcgtcaattggcgaatgactgacagacgttgtcgcaagctgtttgagaattttgggtgttgacacactcacgtggggtttggccaggacaaaccacattttaggcagtttgggaagcggggtcacaatttctccccggccgctgaccaaggctgtgcgactgtagacacaataaggcacgtcagaatcaacctgaacgccgatttgggctaattcttcaaatgacagcccggtctcaaacatttcgttgagtgcacgtaaaacggcggcagcatcggatgatcccccgcccagtccggcagcgaccggaatattcttctcaatggaaatctccaggccaaccttaaagccaaccttgtcaaagaataaccgggccgcctggtaggccaaatttcgccggtcattgggcagaaaactgctatccgaaaaaatccgaatcgccgagtgactgctcttggtttcaatttggatatgatcacttaacccaattgaggtcatgaccatccgccattcaattgagccatccggatggacaaagggggcatccaagcccaggttcaattttgctggtgctctgactattcgcttcacttggatcgacccccttcatttattaataacaaaattatactaaattattaataaaatgtcagttattggctgataaaaggcagtcggagcaaaaaatggccaaaataaaaaggcctcaatggccccacgctgactttgactccctgcagttaaactgcttgggatgcatcaaaatcgacctcaatatttttggtcaaaatatccgtatagctgtacgaaacccgttcaaaattcgcgttgcccggatccaattcgacaacaaaaacagccggaaacgtttccctcaaaattccccggcgcttggttgtctttcttcgcccaatttgagaagttactaggacgtgctggccgatatgatcgtccatcttatgcttgataacagataaagtcactggcattctactcacctcacgatatttaattataccataaaagtaatagaaatgcaatttttaccacaaatcacactatctggcaataataaaacactaagatttagattaaatttttcaaagtgtgaaaggcattcgccaaggtcacaaactgatcaacagtcaaattttcgggccgaacgcccgcgtcgatattgacactggctaaaacttctttaatgttggccttcacttccggtgttttgccaaatatcccctgtaaattattccacagggtttttcgctgatgcataaaacagccacggacgaaactgataaaagccttttgatcaaagggttcaacggcccttttaacccgcggtgtcaatttaacaatggccgaatcaactttgggctgtggaataaaagcggttttgggaacaacgaatgaaatctcgacctgatttaattcctgaacaatgacagacaacgacccatagggctttgttgacggttcagcgttaagccgctcagcaacctctttttgcatcatgacaacaatcgcatcaaactgggtttcgccggtaatcaagtccatgacaattggcgtcgtgatgtaataaggcaaatttgccactaccttgagtggcttttcagtgtcaaagacgtcatcaatgattttgggcaaattggccttgagaatatcctgattaataatctcgatattatcgtatggcgccaaagtttcatccaaaaccggcagtaggttggcgtcaatttcaaaggccacgactttattggcggccttggccaactgttccgtcaacccaccgattccgggaccaatttcaatcacgttgtcggctttggtaatctttgcggcagcaacaatattgtccaacacaccgagatcgactaaaaaattctgccccaagcttttcttggcggataagtggtaacgattcaggattgcctgagttcgtgtgggactggcaatctgtggatattcagtcatgagcttcctcctgattaatctgttcaacagcggctaaaaattcatcgtgtttgatgccaaacattctaaggcgatgctgcagctgtttaccgttaacatagccgattcgcaaaatttcgccgaggcgctcccgccgttttttagcactgggattccccatgaggccgtacttcattaattcagcctttgaaatgagttcaccagctgattcatcctcagtataaacctgactcaaggcttcgcggatcgattcaacgctggcgtgctcgacacctaacgacccatcggatcgattcggaactccctgcttcttggtgataaaggcatgcttagcgttgggaacttccgcagaaatggttttccgaattttttcaccagaaaaatcaggatccgtgaacacaataatcccccgagtttgggccacctttttgatcaggtccaaggtctcttccgggatcgccgagccgcgggtttcaatggtgtcggcatcgactgctctttgaacgcgtttggtatcgtctttgccttcgacaacaatgacttctttaatttttttcatgattcctcgattccaaataaacgcagcgtattttcataggtatgcgccgcaatgacatccgggttgacatcacaaattcttgccagtgcctctaccgtgtaaagcgaataagccggctcgttttgcttgccccgcaatggttcgggtgataggtacggcgcatcggtctcaaccagcatactgtcaaacggtgtttgacggacggcgtcatggacttcatgggttttcttaaaactggcaacgccactgtatgagaccagcatccccaagtcaagaaacttcttgagccattccggatcgccattaaagctgtgcatcaccccgcggatatcggagacatccatttccttcaaaatggcataggtatcctcaaaggcatcccgattatgaaccgaaatcggtagatgcagttgtttggcaatatcaatttggcgtttaaagacccgcttttgcacgtctctgggagaagttgtttgatggtagtccaagccaatttcaccaactgcaaccacctttttgctctggagctgttcaatcaacagctgttcttgttgttcatgataatggatagaatcttccgggtgccaaccgatgattgaatacatgtcagggtattgggctgccaattccaatgatcgatcgttcagctgttgattagaaccaacgttggccaacttaacgacccccaagttctgtgcgtgcttgaaatatttagccgcttcaggataaaggtgttcgtcattcaaatgggtatgtgaatcaaaaattttcattatttgctcccaaactatttagatagaaatagggattgtgacaaaactcgcgtcttgttgccaatccctagtctttcacgatgttaactttgccacaaatcggcaatttattccagtgtgacaccattttccaagtgagatccgacggttaccaactcaacgttgccatctttatgttccacggacagtaacattccttggctgacttgaccgcgcatctttcttggtttcaggttcgacacgataatcacttttttaccaattaactgcttataatccggataccattcagcaattcccgacaaaatttgtcgatcgccgtcatcaccggcatccaagcggaattgaagcagcttgtcggcgccttcaaccttgttaacgtctttgatttcggctactttgagttcaatcttttcaaaggcttcaaaacgaacttcttttttggttaaattcaaattggtttcttcaggattaaaatcagcttcggcagcttctttcatggctgcacgccccttagccttatctgtcttggtcatttgctgtttgatgtaatccacctcatcgtcaacttcgactcttgggaagattggggtccccttggcaacggctttcacaccggcaggaacgtcttcaaacttcaaatcttcgaggtcaatgtcttctgtaatccctaattgagcaaagatttctttaggggcgtgagtcataaccggactgattaattcagcgatgacccgaagaccggctgcgagatgagccatgacagcgtcaagcttatctttgtcatcaggatttttagccagattccatggttcggtctggtcgatgtacttgttggtttgggaaacgagtttccaagtttccgccaaggcatcggagaagtgcaaatcattcattaattgcttgtaattggcaatcacggtggcggcagtctcttccaattctttgtcagcttcgttaacgccggccttgtatgcaggtaagatgccgccgtcatacttgttgatcatagaaactgttcggttcaacaagttgccgagatcattcgccaaatcaaagttcaaccggtcaatgaagtcctctggcgtaaacagaccatcattggcgtaaggcattgcgcggagcaagtaataccgcaatgcatccaaaccataacggtcaactaaagtttccgggtaaatgacatttcccttagacttggacattttaccgtccttcatcagcagccagccatgcccataaaccgttttaggaagcggcagtcccaaggcgtgtaaaatgatgggccaataaatcgtatggaaccggacaatttccttaccgaccatttgcacattggctggccaatatttcttaaagttgctgtcatctttgccgtcatagccaagagcagtaatatagttggtcaaagcatcgatccaaacgtaaaccacgtgctttggatccgacttgaccgggacaccccaagtaaaggtcgtccgcgaaaccgctaagtcttccaaaccgggttcgatgaagtttttgatcatttcattcatccgggttgccggctggatgaagttaggattgtctttgtaatatcgcagcagccaatcagcatacttactcattttgaagaagtatgactgctcgtgaaccaattgaacttcgtggccgctgggtgctttaccaccggttaccttgccgtttttatcgcggtaaacctcggcgagttgactctcagtaaagtactcttcgtccgataccgaataccagccggtatattcacccaaataaatgtcgccattgtccagtagtttctggaagatatcggcgaccgctttttcatggtaatcatcggttgttcgaatgaatttggtgttggaaatttccagctttttccaaagttgtttgattgatgcagccatctgatcaacatagtccttaggcgacatccccaactgttctgctttttgttcaatctttaatccgtgttcatccgtccctgtcaggaagaagacgtcatagcccattgcccgcttgaaacgtgcttcggcatcacaggcaattgttgtgtaggaattgccgatatgtaacttcccggatggataataaattggtgttgtgatataaaatgttggcttactttctgccatgaaagtacctcttttcatgcttaattattctttaggatattacaatccagtatagcaaatattttttggaatggcgatgagaattggatttgggtgagatggtcgtagtcgaagttcaatatcgctttgaatcggtggtgatttgcttttacctagtgataacgtgctcaacggagcagcaacctgcacctaagtatggtcggacaaaaatcaaaatgattttcatccaaccacacttaggctccggttgctatgcgctccggatcgcagtcatttaaaacaaatccatctgcaccggcgacaagccgccaaattcaatccccaacatcttctttaactgcagggcgttgtctgctgcgtccccgccgctattattattgaagatgacacaaacttctttggcctgcttgtccagatccaggaccacttttcgaaaagctgccagttcttcttccgaataccggtacaacgtccttttcccgcgccaatctgctgactgctccgtccagcctttgacgtttcgaccgtgaagccgcaacaacgccagattctccgttgtcaccagcggttcgaaaggcacgccggcattggtggtatgcggttcgtcaaccgccaccaacgtcattcccagttcgctgagatagccggcgacgtcatcggtaatctcgtcaccataccaagttgagttgcgaaactccactgcaacaggatatccggccatcaactggctaattcgacgcaggtactgaatcgtcgcaatctttctggcaaagtatggcggaaactgaaacaggatcgccttgagctgaccggtgtccattaatggggcaaccgcccgcttgtattcgttgaaagccacaaaccgctgctcattatcaaccgggtcggcgctgccctgatcgtgcatggtcatcacccggttggccttcaaaataaattgaaagttatccggtacctgtttttgccagttggtgatcacttcaactttgggaatcgcataaaacggcgtgtccagttcgacgaccggaaaatacccactgtattcagttaagcggactttacgtttagcaccgtcgatcagtgaaggatgctcggaaaacgtcattaacccaatggtaatcaatcagcccacctcccggctgtttagacattcaccgtcaaatctttgaagaagtcaacggcattttctttgaccatcgtaaacggaaaaccaaattgaagcggctcttcattaaccgccagaactttggcattttgagaacgataatcaatcaagccggcaaacgggtagacccgcattgatgtgccgacaatcacgatcagatcagcttgggacactgcctcaacactcttggaaatggcaactggatcaagcccttcaccatataacacaatgtctggtcgtaaaatgccgccacagttttcgtgatacatactctttaaataatccttgtaattgactgtcttgtggcacttctgacaatacactttgtacagattgccgtgaaactcgactaaattctgcgtgttggccttgcggtataggctgtcaatattttgggtcaccacaacggcattgcgtttctgggtaaactcagcctggcgctcatgaatcacgtttggcttggcatccgggtaatacatatttgatttttcgtactcccagaaaactttgggttcatcacgaagacaatcggtacttaaataatactcagcgggtttatcagatttgtcattggtgtacagcccgttctttgatcgatagtcaggaatccctgatgccgtggagacaccggcaccagtcaaaaagacaattctttttgcgttatcaaattcagcttgcagcttagaatcaatcatcgtattcctccttcaaaagttcattacttgcgaacgatataaggcattttaagatcgtcgaacaactgcttgacgcttttatcatagacccctttgaaaaattccggatcgtcctggttgcccttggggttggccagcacaaatgagttctgatcatctacccggttaaagccgacgtaacccttggtgttgctggtaacctcggtcaagtcggaatgataaatttcaaatagctgtttaactttcaatcccagttgccgttcagacaaaacactggtaagggtggtgaactccgtgttgtgcagagccggcagttcccagtcctttaactgttcatcaaaggctttaaagagcttgacgacgttgcgccgcaatccaaatggtgaatcggtcggcttatcggtgatcacttgatacaacttttgggcagcctcaaaggaaaccgggaaatcctgtttgaatttgtcagccaccttgtcaattccctcgccgtaaaagaccagcgcatccaataacgtggttaaccgtaacatcatctgatcgtccagtggatccggttcaggtttgatggtcgcatatacgcctttgagatacatctcttcgatgtcgtcattgatcaaattgtgctttcgctgctcggacacaaccacaaaatgagagacaatgtcgtagagttccgttcccatcatttttaattgttcatccagggtatcatcgccagtggtcagtgaataaaagacctgcggaaagccgcggaggaccatcaataggtgcagcagttcatgtgaagccgtgtagtcgggagcacttaagtctgcgatttggacgatgatattttttccgtcctgaaccgtttgggcctgatcgtgacgtacatatcctgattgcagcttgccgataaaagtcaccgttaccgtcccgggaaagaagttattaacggcgtcaattaagccgtgaacgtctttgtttaactcgatatcaatattgttatccatcatgttctcctatctgcgaagtgtttttaaaatttctttaactgtttgtgaactgggatgatccatcccctgaagctttcgaacaacaactggcaactcctgcattgtggttccatttgaaagcgctaaggaccttaattgaagattcatatggcccttttgaataccatcggtcaccaaagcttttagggcagccaagttttgagccaaccccagtgcggcgaccacctgcatttcctcacgggaattgccgatctgagcgatctgcttgttaatgccggccaacggcaaaaccttgctggcaccgccgacaaatccgattgggactggcagcgacatgcgtcccaccagttgatcttcgtcaatctcccatgtactcaagccttgatacgacccacttcgagccgcaaacgcatgagctgcgctttcaactgcccgccaatcattaccaaaggccatcacggcggcgtcaacaccattcataattcctttgttatgcgtcgtcgcccgccgaatatccaactgggcgacctgactggcatcggcaattttttgggccacctgagggccagataacgacttggttcctagtttggccatcgccaccttaccggaaacttcaacgatcgcttgatcaacgaaattcgttaagattgccatcgtggtttcaaccgtcaactgctcagaaagccaattcgacacagcttccaacatcgtattgatgatgttggcgcccattgcctcaccggtatcaaccagtaggtcgaccgacaggaactgcttagagagaatccggacatctaggcctttggcacctccaccatactttaaaacgcttggatgactctggtctgcaatttgaatcagctgctgctgataatcatgaacaaactttgtcacctgatgaggatctgcgtctttgacgatgatctggccgctcaccaggttatcaggaacactgcaatgaatgcctgctcctgccgataacagtttggcaccattgctggcagccgcaatcactgacggttcttcagtcaccattggtaccaaatgttcgtggccgttgacaaccaggccaactgcgattccctcagggagtggataatccgtcagattgttttcaattaattctccggaccttgggttcaaggaccgtccaagcaaatcgagttgagcctttgataaattggcagcttcagcgatcagcgaaagacgctgctcgtaagactttttatagaaatgatcccgtttattttccatgatatcaccatcatctgttagaggcacaaaaagctggtacaattgccagctttactcgatgccgtattctttttgaatgtactcggtaatgatgccttctctgacaccactttctgaaaataagacttttttggcatcaattttgtccattaaaacaatcaacggcaacaggccgccgacaataatgtcggcccggtcgtgctcaagcccctgaattttccggcgccgattgacgttgcccttcaataaattcagataggttcgattaacttgttcagcagttaaatgataaccgtgaattgcatcaattcgaaccatattttggcgacggcgattgattctcgccaaggtccgattggcaccgcccaagagaactaacggctgatgggccgcacgattcaaccaatcaattcttgaataaatcttcctgatattaaattgggcgttaaataaattcgcaccggtaatattatcatttaaatgatatctttcagtgatattcactgcaccaattggaatgctggtgagatttgagcttttgccctcattgacccgaatgagttcacaactggcgccgccaatgtctaggatcagacaattcctgattcctaatcgattaatcacgcccagataatcgtaataggcctcttgattgcccgaaaggacctgaagcgaaataccaatgcgctcagaaacggcctttaaaaacttcgcctggtttttggcttggcgaacggcggccgtggcaattccaatgacccgtttggcttcatattgagaatagatttgtttaaaatctaacagtgacttaatcgtccgttccatggctgccggctggaggatcttgcccctgcccatgccttcggaaaggcgactgtcacttttgatgcgtttgatttcacgataactgccatcatcagaaatttgattgattgccattctgaccgaatttgagccaatatccaaaattacaaggttttccatccctgccaccctttctggacatattagtcaaaatagttaatgccaatggcatcgcgaacttctttaagggtttgattggcaacctcgttagcgtgttcactgccctttttgagaatttgatagacaccctgctcatcttcagcgtaacgctgacggcgctcacgaattggtttgagttcggcttgcaagacatcgtttaagtaacgtttaattttaacatccccaaggccaccatggctgtattgatcttttagttcctgaacttttcgtttgtcaggatcgaaaatatccaagtaggtgaagaccgtgttgccctcgacttggccgggatcttcaacgtgaatgtgatttggatcggtgtacatggacatgacctttttttggatggtgtcttcatcgtcggccaaataaatcgcgttgcccaaagatttgctcattttggcattcccgtccaagccgggaattcggcccattccctttggtgggaaataaccctctggctcgactaaaatgtcatcattataaacggagttgaaagttctgacgatttcacgggtttgctccaacattggttcttgatcgtcaccgaccggaacagttgtggccttaaaagcggtaatatcagcggcttggctgattggatacatggcaaagccaaccggcacactttggccgaacttcttttgtttaatttcattcttaacggttgggttccgattcaggcgggaaacggtcaccaaattagaataatgctgcgtcaattccggtaaagccggaatctgggattgaaccaggatagttgatttttgggggtcaattccaacggccaaataatccaatgccacttgaatcaaactgtggcggatcttttcaggatcacgggcattgtctgttaatgcctgcatatcggcgatcataataaatgtttcgtagtccccagagttttggagctcaactcggttctttaatgagcccacataatgaccaatatgtagtttgcctgtgggtctgtcacctgtcaaaataattttcttcgtcattgtaaccatcctttcaaaaaacgccctattgctttaacaataggacgcttatacgtggtaccacctaaattgtaacttatatcaggttacctctcgagacgatatgggcgtcaccctttacatactccaattcgtttcgtcgtggccgttttcagcaagtcgacctctctgttgctgacgattctactcagtttttaataacaatctaattttactgataaaccgctaaaaagtaaaccccgtttgcgggtaaaatacgggaagttttggcttagtatcctgcagataaatcaaccttgttcacagcaactttgccggtttggatgaagctggtcaggttttgatacaaaatgccaaatgcctcatcaccatattcttgaaagccaccggaaatatgtggcgttaaaatgacgttatccatcccccagagtggtgaatcactcggtaacggctctgattcaaaaacgtccagcccggcaccagccagttggtgttggttcagtgctgcaatcaacgcctcggtgtccaccgatggaccccgaccgacgttaataaagattggctggttgcgcatttgatcaaagaacgcctggtcgaagaaatgatgagttgccggggttaatggcatgatattgatcacaaaatctgccttggcagcttgcactactccttgatcgtctccaaccacttggtcaaaatgagccgtgggtttgccatgccggctgacgccaaccgttttggtaccgaaagcttggagcttttcggcgattgcccgaccaatatggcccgttccaaaaatcaccgcggttcgatttttgattgtgtagttctgcattcgaacttggtcaccgagccacttttgatcacggcgggccgcttgagtggtgacgatgcccctggcaaatgccaaaacgtaggcgatcaccatttcactgatgggttcggcgtggatgccgctgacgttggccaaggtaatttctttatccgcgaagtcgttcaatggcatgtagtcgaccccggcagaatttgactgcacaaatttcagcttcggcgattcacccagcacggtgcgggcttgctgattccaaccatagattgcatcgacacttttgacattgctggtattcaaatcagccggttcgatgacctgcacatcgccaagcgctgtgagtttggcctgctgttcggccgttaaattgaataaatccagaatcttcatggtcccatccctttcattcgtcttgatctcaataaaaagtatacgcttgaaattggttcaaacaaagcaaaatccccaccccacattgaagggcaacacaattgacaacggggttaataccaactaaaattgtcgaagcattcttaattcacagtcgagtcgaatccgaatggaggaacccttttggaaaataatgaaaagcaaatcgaacagtcacgtgtggacaaagtggtgaccaaaattgaccagaaaatcatcagcacggatgacgaacttaaccgtgcccacgcagaaaccaaaaaggttcagcagacttattccgacaatacctcggttaactattttgaggtggatgatcgaattgaaaccagtgccgaactccagcagcagcggggtttggtttctcgtttaaccgaaaatgaaagcatcttaaaaaatcagctttcaactttgaaagatctcaaaaaatccccgtactttggccggatcgatatccaagacgaggacgaggacgaaaccgaaaaattgtatatcggcattgcttcatttgaaaatgaagacggtgagtttctggtgtacgactggcgggcacctatctccagtgtttactacaacggcaccctgggtgaagtcgcttatgataccccaatgggccgacagcaaaccaatttaaaaaagaagcgtcagttccaaattgtcgacggtcaaatccgcaacatgtttgacaccaacgaaacggttggcgatgaaatgcttcaaagtgctttgggtgaacaaaacgacgaatacatgcaaaatatcgtcgccaccattcagcacgaacaaaacgatattattagagataccaccagtaatctgctggtggttcaaggggttgccggatcggggaaaacctccgccattttacagcgaattgcctttttgctgtatcatagccgcgatacgcttgaagccgaccaaattattttgttctctccaaataaattattcagccactatatttccgaagtgctccccagcttgggtgaacgcaatatgcgccaagtcacctttgatgaatttattgataaccgactaaagggcctcaacgttcaaagtttatttgaacgatacgaaactgatggtaacttgaccgaacagcagcgattggttcgcggcttcaaagaatctgccaaatttatggacgaactccaggaatactgtgataatctccagccagcccaaatcttcttcagtgacatcatttttaacgaatcaaccttctttagcaaacaggaaattcaagacattttcgacagttttcccaaagcagccaaagtttatgatcgcttcttacacaccaagaatgaattgatcaagcgactcaaacgccggatcgacgacgaaaccaaggctgattgggtcaacgacgaaatcgatcaaatgagtaatgagaagtaccacgatctcttggccggcaaagagctgggtgagttccaaaatgaagatgccgagcgcttcttcattgcccgaaaaattgtcagtgcccgcctgcgggtggtctacgatgcgatctttaacgacaacttcttcgatgcctacctgcagtacgccgacttcttgaaaaaagtcgatctgccgcaaaacattgaaacgccgcagtggctgcagtccgttgacgagtttaatcattcaattgaatttcatgccatcaaattggacgattatgcgccgttgctttacatgcgcgactatatgtctaacagcggacagaacaacactatgaaatacctgtttgtcgatgaaatgcaggattattcagtggctcaactcaaatacctgcgctacgcctttccaaagacaaagtggacactattgggcgacagtgagcaggccctgttcaaagacgttgaacagccaaaagaaattcttgataaattaaacgccgctttccatgtgcgccggtcccgactaatcagtttgatgcggtcgtatcgctcaacgctgccgattaccaactttgccaaatccattttgcctaacggagatgacattgaggccttcacccgccccggcgacattccggaattggttttgacatccgacttcaatgacggcatcaagcagcttgaaaaagtaatcgctgaccaacgcaagcaatacgccaccgttgctgttttaaccaaaaacatgaccgaggcccagcaggtctatgaacgactgcatgccttaggagatgttacgttattgcaggatgcggacagaacacttccaaagggcattttggtgctgccaatctatttggcaaagggcttggaatttgattccgtgatcgcttgggatacctctgagaagaactattccgatgaaagtttgcttggaaccctctacacgattatcacccgggctatgcaccacttaaccttgatcagtctgggcgacgtaaccccgctgatttccgatgagagtttaactgatcgcaagattaaaatcgaaaaaaagattcggaagtaattggtgtgaaaacatctgattataagcaaacccggagctgtggtcattgatcacgctccgggttttttagtttcacttagattgtatggggatagacactgttcacttttatctcgcaaaaacgtgccccttgagccagctttctcttgattacactaatgctcagaagctaaacggctcaatcgcactctagatcaaatactgcacatcactcgccagagttggataagcgagaatttcccggttgaagtcgccgattttcatgtgctgatcaatcatcatcgtcaaaatattgatcaaataatcagcgtgattactcaacacggtggccccaacgacagtttccgtatcgcgattgatgaccactttggccttggcgagtggctcattgagtcgatgataactgtaccacttggtcatgtcattggtaatcagcatatagcgactatcatccgtcgcgatattcgatggcagtcccacttgaccgagtgagggttggccaaagacaattgtgggaatagatttgaattgaatcggatccgttgacccgttaaagtagccggccaagtagccagcttcaaaaccggcaaccggtgttagcttgggacgtttggtgctgacgacatctcccatggcaaaaatctttggatttgacgtctgcaggtggtcgtccacgatcacaccgtgttggtcggttttgacaccaacattttggattccaatcgtatcaacgttgggaatccgccccgccgtgcagaagaccatgtcagtcggcagcttaaaattgtctccggataaaacaaactgctcgcccacttgggtaatttcttgaacacccgtattcaaatgaaaatcaacgcccaacttggccagtctatcaacttcttcgtggactaattgttggtcaaactgtttgagtggccgatcgttatgatgaatcaggtgaaccgtcgctccggccgcgcgggcaatcccggccagttcaaagccgatatagccaccaccgacaaaagtgacgtcgtttggcagatcatcgaggttcaaaaagtcggtactggttttgaaaaattgactgccgggaatatctaaaattcttggccgctgaccagtcgcaataacatattgatcaccggaaaggctttgatttccagccgtcagcagcccatctgaattgaattgggcatgctcatgatacgtgtcgaccccatctgaaatcaacccgttgttggtggcatcagaaattggattggtatactgccgcttgtggcgcatgagatccggccaattaaccgataccgagccactgatcccgttaccctgcatatcattgacaacttgagtgatctctaaaccggacaataaaattttcttcggatcgcacccgcgattggggcaggttccaccaaacaaattgtcttcgacgaccgccacggttttgtgctgtcttctgagtgagtgggccaaagacccgccggcaaccccgccgccaagaatgacgacatcatattgttttgtcatttagtattcctccataagcacctaattcatcgttgattgacgatttcacacgactaatttcataatcttaaatccattgtagaacacttcggaattatttccacgttgccttgattgacaactccccacggaatttgtatcttagataatgtaattaaaattttattaaattgaggtatatcatggtccatgcactttggcgtcaatttccgcgcattaatttaaaactaattgctttggaaccctatttgttaaacgccgtcaatcttcccaaccagcccattcatcataagatcagccagttgctcaaatccggcggaaaattcctgcgtccgggcttcttttacatttattcagaatttggtcaagaggtggatccagctaaaattaaggctggtgccgccgcagtcgaattactgcatgtggcaactctgattcacgatgacgtgattgatgagtcgccgatccgaagaggcatcgagacaatccatactgaatatggccaaaaaaacgccatttatgcgggggattacctatttacctgttactttacccaggtgctcaaatcgactcaggatccggctaatatgaagcgacacgttgatgccatgcaaaccattttagccggcgaattggatcaaatgaaatacaacttcaatcaacaaatgactgaggcagattatttccacgaaattaccggcaaaaccgccgaattattccgcctttgtttccagcaaagtgccttggtaagccaagcttcggatcaaattttcaaacttggcggcgaaattggtctaacgatcggccaagcctaccaaattttagatgacatcttggattacagcggtgatccccaccagaccaagaaacccgtccttgaagacctcaagtccggcgtttacaccctcccattaatttttgccctgcagacggctcagaagcaattaaagccactgctggataaacgtgaacaactgacccacgaagacattgcccaaatccaagccatcgtcgttcagtcgggaggattgcagcaagcaatccaatctgccaatcagttaaccgctaaagccgagaagctcattgcccaattgcctgagcgaagggccaagcgcgacctccagaccctgacacagctattattaaccagaaagcaataatttattttgaaatatcaattgccacagccagaggacagatatctcctggctgtggcaatttttgcgtttgatgcggttgattgagatgtgtgccgatgaccctgccccctactgtgtaaaaccaaccgcccaacgatgaaccaaacccgttcatcctttggcggtttgctttacactccggggccacccgggtctcgttacactcttcctaaatgtgtgccgtcgaccctgtcccctactgtgtaaaaccaaccgtccaacgatgaaccaaacccgttcatcctttgacggtttgctttacactccggggccacccgggtctcgttacactcttcctctgtccaagtcatacagctgtctgaatcttggctgagtcttatacagttcctgcggggtgccctgcatatcgaactggccgttttccatgaaacgaacctggtcgacgtgggtaatccctgccaaatgatgagtgacccaaataatggtcttgtcatgaagtaattcaaagactttatccaacaacttcttttctgtgatcggatccaaacttaccgttggctcatccagaataataatcggtgcatcctggagtaaaatccgcgccaatgacaatcgctggcgctccccacctgagaagcgtttaccagcctcttgaacttgggtgtcgtattggtcgggcagcgactcaatcaactctttcagtccaacggcggcaatcgcatcttttacctgctggtcactggcattcacgttccccaagcggacattgttcatgaccgtcgtgtcaaaaagatacggttgttggtcaagaatgccaaacagtgaagagcggacgtcctggaggcttaaaatattttgctggttaatcagcacttggccatcggatggtgtcaaatctccaacgaccagcttcaagaaggtactcttcccagttccgctgggtccaagcaatgcgaccttttcgcctggatgaatggtcatcgagatatgttgaaccacgtctcgatcaccatcggcatacttgaacgtcaaatcgttaattgaaagttccttgaacggttcagccaacgccgtctgcttaacgggtttgaccgtgcctgaatctagggcgttaacccgctcaatcgaccgtttataaaccggccactcactggcaccttgactcatgttgacaaatggtgacaccgctgggaaaatggccagcgcaaaggcagccacccagttggccaaggatttggaggcggtgaactgattagccgaccagaccagcagaaccaaagtcgttagtaaaataacaaattgaaccagaaatgatcgccaccactggaagtaatgatctcgtttccgcagggctgcaatggccttaattggtttcttctgcaggttgatgaagtcgttgtaacgaccggaaatcagccagtcgcccaatcccaaaacttcatcggttaaattcgtatagaattcgtgttgaatttgatgctgtttaaattcccgaaccccgttggtggcgactgacgccaaaggcatcacaatcgtgataatccctaataacagtaacatcagtaaaccgaccacccagttcagtgaaccgacaccgatcaccacgaaaatgtacaacagccaaccgattaccataggaaaaacggttcgcagatacaagttttcgatgtgatcaatatcgtcggctaaaatactcaagatatcaccggtttggtgagagcgttgaatggccgatgccttttgctcaacggtttgatacagcttttttctgaagtcagacacgattcgcagcacccaattatggctggttaaccgttcaacatatcgaaagactggccgggcaattccaaaggctcgggccaaaacaaccggtacataaatataaataatacttgaaggctgtctggcagcctcactgatcagatatccggagttaaacatcaaagcgccgccagagaagaaggtcatgaatcccaggaataagaccaggaccagtaagcccttgtatttacgcaggtaaggcatgacccaggtgtcgttttcgaatgtttttctaaaatttttcataggtctgccgcctccatttctgaacgaagtttgacgtaatcaccatttcgctgagcgagttggtcaggtgtcccctgttcaaccaagcgaccatgatccatgactaacacatagtccatctcaccaatccagtgaagccgatgggttgcgaagaacaccaggtgatcattgaagacgggcagaatatcctgcttcaaactggcttcagtttcaatatccaaatgagcagtcggctcatcaaataagagcacttttcgattgggatcaagaaaagctcgggccaaagcaatccgctgtgcctgaccaccactgaccgtccgggcaccctccccaatcatggtattaagcccgtccggcaaggtattaatccagtcggtcaggcccgccttgtcagctgcatttgaaatcgcagcttcagtggcatccgcgacgtaaaacgaaatgttatcggctaacgtggcgtgaaagagatagggattttgaggaatatacagaaagtttttctgccaattagcttggttcaggtgtggcagcggctggccgttaatcgagatttgattttgaccatccggggacaaaaagccaccaatcagattaatcaaagtcgatttgccggatcccgatgcaccgatgatgccgatcttctgcatccccttgatatcaatcgaaatatctttaagcgtcggttccttgcttcccggataggtcaaggaagcttgattcaatttcaaggttgaatcgttgttccatttcaaatcaggcaaaacttcgcgttggctcatctcaggctcatgaaggacgtccaagacggcgctcatcgcgttcttaccgttcaaagttgcgtgatagtcgttggcaaaattccggattggcagaaaatactccggcgccaataccaaaatggtcaacgcgggtaagagcatgactttaccatccatcaaatcaaatcctagaaagactgcgacgactgcgatcgacaaagtggtaaagaaatccagggcaaatgtcgatgttaaggcgattctcaacgtggacatcgtttctgtccgataagattcgctgacttcatagacattgtcagcatagcgcttagaaaggcccagctgctttaaagtcggcaggccccgtaaggtatccacaaagtgattagacaggcgctgatagccttcatattgccgatctgccttactctgagctgccagtccaagaataatcatgaataaaatgataattggaaaaatagcaaataagaaaatcgcttgttcccaacgcaggaacaggacgtataacaaaatcagccacggcgtaatcgacatatccaagatcttgataacaaccaacatcaaataagtctgaacctggtcaattccttcaagggccatcgtgacgatgtttccagttccccgtttatcaatttcagcgggaccgagtcggaaaatcttggccatcaaatcttcccgcatatcgccacttgtcttttcaacgaacggaaataatacgtggttttcggcgacagtcaacaaatgccgccctaaaaatgcaacggtaaacacaacggtgggccaaataattgtgttgatcgactgcagattccacaggttcacgattgcaattgacagtgcgcgagcctgagcaattattgcgattgcctgaatgaagaccagaatccctaaaataacggcatactttttcatccccggcagatcaaacaatcttttatcaatcaaacttttcactcccccagaacaaaattaattacaattcctagtataaagaattattgcgcacaatgaaatatgtgagcggtttatttcttgatttatttggtttttaacacgagttaccgccaaaaattccgggcaaaacaaaaagaccagcgataagccgaaacgtttatcattggcctttcagttgatacgcatatcattaactgaaaatcatttacccggatcgttggattcagttaaatactattcagcaacttgctttggtgacttgattcgcttgtagaatacccagtagctccaaatgaagtagatgagcacaattggtaaaatcgtgaatgtcaaaatcgtcatcaagtgcagcgtatatggtgaacttgaagcatttttaattaagattgaatttgcgttgttcgtcgcaatcataacccgtgggaataaaccgttgaaaatcaggacaacgacactgattaaagaaagcccactggcaatgaatgatgtccaatcatggctggactgagcgccccaccatgcagccaaggtaaagatgaccaaggcgatcaagattccccaagttgacattggtttacgagtaaagaagtcagttgttaagtaaagtaagacaacaaagacaacttcaccggcaagcagaaccggatagagaactttactccacttttctgctcgttctcttaattcaccgctggtcttcaaacgcaggaagtttaatccatgaatgaagcaaagcagtgaaacggcgacaccgccgacaatcgagaaccagttgacataagtggtgaaacttccaaagatatccccatttttatcaatcggaacaccttgaatcatactggtgaacatcatcccgaataagaatgcggcacagaaactaccaattgatgatgcccattcccagaaattacgccaagtatccgtctgcatatttgcacggaactcaaatgaaacgccacggaaaatcaaggcaaccaagattaagaacaagacaaggtagtatcctgaaaatagtgaagcataccacattggaaatgatgcaaacatcgcaccaccggcagtgatcagccaaacttcatttccatcccaatgcgggccaattgtttggatgacggtatcacgttcagcccggttcttagcaaagaatcgaacggacatcccgataccaaagtcaaacccttcaaggaagaagaagccactaaacaacacaccaatcaatagaaaccaaataaattgataactagtcattatgagccgcccccatttcgtatggatctaccttttgatcagctgcttgtggttcgctggagtatccgtcagtctgaactgaatccggtccttgtttgagaacccggtgactcaggataatcatgacagctccaagcgatgcaaagatcaagaagtaaacgatgttggtgaacatcaggcttgccacggtagacgttggcgataccgcatcggcaatggtcaaaagtccgtaaacaacccatggataacggccaaattcagtaacgaaccagccacaggtgttaacgataaacggcagccaaaccatcaagcccatgaggtataggaaccagcgttgcctcataatgctttgtgacttcttacggttgaaccataacccaatgatggcaactaagccgaataagccggcagaaatagccatgattcggaagctatagaacaaagtacgagttggaacataataattccgtgtttcaccatttttattgtactttgcctttaattctttgttgatctgttgttgacctttgaaagttccgttcaaactatggtgaccaagaatattcaaaacataaggaacctcaattgaccaggttgtcttgtgattcttagtaccctggatcactgaccaattgcccttttgagttgagttcttccagaggccttccatagcagcaaacttcatcggttggttattaatcaggtaacgtgtttgcgtatcacctgaccatacagaacctaagcaggcacaaagcccaatgatgagtgaaaccttcattgacttgcggtagaagtgctcatgatccttcttaagtaaacgccaagcagaacagccggcaacaacaaatgcagccgttaagaatgccccgaaaataacgtgtggaaattcgttccacaactgacggttcataataacagcagagaaactggtcatttcaactttgtgttgagcagcattcattgcgtaaccaactgggttttgcataaagctgttggccgccaaaatccaaagtgcagatagtgtcgaaccaaaagcagtcagccaaatgaacaaacagtgaaccactttgttgaaacggtcccacgtgaacatccaaaggccaatgaatgtcgattccaagaagaaggctgccaaggcttcaattgccagtggcgcaccaaaaatatcccccataaatcttgaataatccgaccagttcattccaaactggaactcttgaataataccagttacaacaccaacggcaaaactatacaggaaaatcttcccccagaattttgtcatgtttttgtatgtttcatccttggtcacaacgtaacacgtttccataattgcaacaataaaagctaaaccaatggaaaacggtacgaagaagaagtgaaacacagtggtcatcgcaaattgaaaccgcgacaacccaagcatcgtgacgccaatatttaacattgtcgtatccccccttactaaatattaatgagttatcctcatatacccttattgtatatagaaatggttcaacattcaatcaaaatactaattaattatcagcaattactcataatcctgcactgttattgacacaatcccgcccgaaacatgtaaacgtcgtcaatcaatcaatgtgaaggacttagattagggaagaaatgcttgtgaaattattgcaatggctttcattagacaattgtcaaagccacatttataataagggtgataagattagtttatgctattattgtaattttctaaagcaatcttattttaattattccaaagggggaaaatttcatgacaaagaacatcgtcgtcattggtgccggtttcgcaggcgtttacgcaaccaagcaattggctaagcgattcaagagcaactctgacgtccaaattacattgatcgatcgtcactcgtacttcacttatctgacccgattacacgaagttgcgaccgagcgggttgacccaagcagcatccagtatgacctgcaacggatttttcacaagcagaaaaacgtgcagctcgttacggataatgtcacgtcagtcgataaggacaagaaaattgtcaacggtgaacatggcacgtatccatttgacagcctgctgatcagtatgggtggcgagcctaatgacttcgggacacccggcgttaaagaaaatggtttcacgctctggtcaatggaagacgcactccgacttcgagcgcatattcgtgaaatcattggccgaggagctgttgaacgtgatcccgacaaacgtcgtgcaatgctcacaattgtggtctgtggttccggatttaccggtgccgaaaccattggtgaattaattgattacaagaaagtcctggcaagagattacaagctggatcctgacgagattcacattctcttggttgaagctgccccaacaattatcaacatgcttgatcgaaccaatgctgctcacgcagagaagtacatcaaggatcacgacgttgaagttcgaccatcatccatgattacctcagttaatccagacagcgtcgacattaaggatcaggattcaattccaaccaacaccttgatttggactgccggggttaaaaccaaccacgttgccgacagtttcggaattgacgccggccgtggcggtcgattgattaccaatcaatatctccaggcaaagggctttgaagataaaagtatttacgttgccggtgatgactccaacgccactgagcaaggtgctgaacgtgccgttccacaaactgctcaagaggctgaaaatgaagccgttgtttcctctgccaacattgctgctgacattgaaggcaaccacaactacaccgaattccatgacaagaacatgggcttcaccgtttcatttggtgctcgttatgggattgcccaagtattcggcggcaaacgagtccgtggctggctggcaacgattatgaagcacgggaccaacctcttgtacttcatgcgaattcattccggttacttcatgatgcagtatatcttgcaagaattcttccgggttgataacaaccgaactgtgctgcctggtattactgcccgtcaggggaacgctttgtggagtgttccgctaagaatgttcttgggaatcgtcctaatggttgatgcattctcttacaacgccattattccagtgggctttggcctgactgcgattgaaggcattattggctgcctgttgttcttcggtctattcacttggattgccagtttggcattaatcgtgatcttcttcatggggattgccagctggccgcatgcttggatcgtctttgcggcgattgccttaatgaatggatccggtcgttccattggtttggactactggttcgttccatggctgcaaaagacttggggccgttcacgttatggcattccaaagtcactttacaaaaataaataaccgttaaatgaaataagaggctggaacaaaagattttgttccagcctctatttgtgtctgaatgttatctagcacttatgattcagcttgagtttccggtatctcaacaatgtacttgccataatgaggaacatcgacaatttgaatattagtctcaaaaatgttggctagtaattcacgatcgtagcattcttccggtttgccgacttttaccagttcaccccgtttgaccagccacaaaacatcactgatcttaaatgcctgattgatatcatgaatcaccatgataatcgtgatgtgcttctgctcattaagctgcttcaaaatccccatcagttcggcttggtagtgaatgtccaagtaagtcgttggttcatccagcaatagatatgtcggatcttgggccaaagcggaagctaaccagactctttggcgttggccgccagataacgacgacagcggccgctgtgccaatgatgtcaaatgagtgacctgaatatacttggccacctcggcgtcagaaattgtcgccagcaggccgtggtgtgccaacctgcctgttttaacaacatcaatcactttcatatcatcaaaaatatcgttttgctgactaacaactgcaaccttggtcgccaactgtttccgaggaatcgaactaattggctgcccgtcaagatcaacttcaccaccggacggttggaaaatgcccgccatcaattttaacagggtcgacttgccggcgccatttggaccgataatcgatagaatgtgccccaccggaattgtcgcactgatctcatttaaaagggtcggttgttgtggataatgataactaacttgatttaagtccattaaaattcttcctttgcaacatcaagattaagaatgggccgccaatgacggtcataatgaccgcggcggacaattcactgggcaacacgacaattcggccgatggtgtcaacaactaataacagccaagcgcccatgagcatcgacagcggaatgatggtttgataatctctccccactaaataacgaacaacgttggggacaacgattcccatgaacggaaccgtgccgacaactgaagaaacgccggaggataaatagacaaccaccaacagcaatgccagacgcatcatcgaagccgaaacccctttggtctgcagctgctcggttgataatttgagatagttggcccacggtgaaataacgactgccgcgaacatcccactgacacccaaaaataacagtacttcggtctgcgaccaggtaatcccgttaaaagagcccgtcgtctggccgccaaatccattggcaaacagctgctcgaacccggtaaaggtcagcatcatcgccacaccaatgataatcagccggtatgggctcttgagtgccggcccccgggttaacagtaagagtgcaaataagccgccaaggatggaaaaaataaacttgctggcaggaaatgccggtagaagcattgtcccaatgagaatgaagaagtctgaagcgctggtcactcccagaatactggggtctgccaacacatttcgaaaggcagcctggctggcagctcctgctaccgcaagcatacccccacacagcatggttgaaagaatccgcggaaagcgaatgttaatcaacacgtccagttgattgggattgcccccttgaaaggcggtcatcatttgttggggggtaatgaagctggcccccaacatcatcgcaaacaaaatggtgatgacaagcatcaccaaaattgtcgaataccatattttttcagatttagtcaattcgtttggctcccttcttgaggatacagccaattcgaaacgatctgcaaggctttggcagcccgcatattggcagttgcatcaaagttgggttcttccagatcataaacgcgatgattcttaacggcaggcagcgtcttccacatcggatcggatttaaattccgagttaaattgtgggatcacgatattgggtaaggcgtgtgccaatcgcaaaataacctgtggctgcgcttttttgatggcttcatcgttgggagagacaaactcttgtgtctttgaagagaaaacattgtgaccaccggcaattgcgactaaatcaccaacgtaggattgattagtggcaatcatataggaagccccaggtaaccccatcaagacaagcacccgaggtttggtggcatggcgcttggcaaccagtttaacatgctgctctgcctggtcaatttgatcaactgcgtgtttggcctgggcttttcgctgatattgtttccccattgcggtcaccgtttgtttcaatttggtgacgctggttaaatccagaaaatggggcgtaatatggcgttccttaaatgcccttccaaattggtcctgcagggtcgtcacggaatagacgacggtcggttttaaactggcaattttttcaacactaggattcatcggattgccaacccgggcagcgtgcgcataacgcgccggaattttattttgagttgtcggcacaccgaccagcgggagatcgagcttatctgcaatttgaacgaccgcaaaagtcgttgccacaatccgagcttttttctgatgattggcagcaccgattcggctcataaagataccgcccaacacgccaactaccaaaacaagtgagagcacaattaaagcgatcttacgagatcctttcattatccttattgccccctctaatgtttaaagtaaatccacaatcctgctgaaagtccggcaatcacagtcacgccgccgacaatccaaggaaccccgctcttttttgcttggggtttgtctgaagtctttttagctggtttggtcaggttactgctggccttacttggctgtgatgaggctttcttggcggaagactgttttgctttgggttgctttgtcttggttgagctagcagtcttagcagcttttttggtcttctttggtgcattggctttgggtcgactgttggtttgctttgccttcgtacttggactagtagccgccttaggctttgtcgttgacgtagctgtcttaggtgtcgccactgcggcgtgcgtccttcccaagcttggcagaccagccgtactaaatttgaacgaaatcaagtgatgggccttataaaccttgggcacgtcaatagcgagcttggcattgatccgtttcttcaggttattagcataaaatgaatagtacagcagcgaatctccggcccggtctttcacgcgacggacatttaatggcgctttaccgttgacccaattcactttgactggaaatgatgacaaactcttggcagttttaatttccatcgtgacgtaatagagatgatttttcaccaccacattggccggcttaacaaaatagccgtctgccattgacgtttgattggttccatagcgcaatgggtgataggcaatggtttgagcactagctggaataattgaaacgatgaacagtccaatggcgacaaagaggcccaatagccactttgatctatttgacaattccatgattactcccccaaacaaaagataatcctgatacgagtgctaatccaagcattgacaagctgttttggctggcatcaccagtttgtggtaatttagtctggctggaagtgctcagcttagctgaagtagctgtcggtacaacagcaacatgcttgctggccttggcaggcgctttttggctaaacttgaaacgaattggccaagttgtattgatttgggcttgagggacaaccacatggattgaacccttgataactttcttcaaagttttgaatgatgaaacgttaaatgaataagtcatggtgtagtaattagtcgtttgaccataactaacaactgaggatttcactttgcggccattgatggtcactgggcgaacagcttttgaccccaactttaagttcttcttgtaagcaaccttcagttggacgttgtagtgcttagcaatttttttaatcacggccgttcgagtgtaatattggttagccattgactttgaatttgagtcaccctttaaaaccacatactttcgagttgtggttggcacctttgctttagcggtggtcttctttttggtggtaacagttgacgtggtcgttgtcgtcggagttgtagccgaactgctggtagctgcaggcgttgtggcactgctgctggtggctgcaggttcggtcgtggtacttgaatcagttgtcgtggttgtggcggcatctgatccaggaacctttacagcatctgcccagtcaaacgaaaagtcggcagattcttgcatttgtccaagaattggaatgttatgaagcgtaaagctaaccggcatagtgctgcttggattggtcaaattgaacgttaaggttccattgttcccagaggtcacaattggcaatgccgtttgatcccccatcgtcatgctggcaatatagttggcaccgtttgtcgtaatgacagtcgtataggttcctttagacactgtcacctgggcagtttggtcaaaaaaatgattggcaatcgattgagaactgctgccgctcttcaataaagtaattggtacagtgtacgaagcgtcacttaggttgacagaatcagccttagcattggatgaaaatgcaccccccacaaatgcgaaaataattgctacaaaaacaaactgaataaaatgtacaaaacgttttttcatgcgaaaatccccctttaggtataaaaataattgtacacagtaagtttaccattagtttggaggtaaataacgtcaaatttgtgaattgataggcaaaaagcattactttttctcaagcgctttcttgccacattgtttatggattttgctcttaaacaactgacgaagttaattaatcaaaatatttatctggttaatgaacaacggctgatttgttaggaacgcactgaacaaagaaaacccagccagtacttcacgtttttttgccggaacaagcggtcttggcgatcgtgtgggtgccaacctcaccgccggtatcacagcaagcaaagtccatataagagcatcatacatcgtctgttgtttgagatacttcgataccactgagtccttacaaaaaatgcctccagccctcatcataagaggctggaagcactgggcggttcatcaatctaaatgtatctgacagccattgccaggatttgaacctgggaccttttccttaccatggaaatgctctaccttctgagctacaacggcatggttgaatcaaagaacataaatcgatattatcaaaaaaagcaccgatagtaaatactatcgatgctttaggattaaaaattggattagacggatttaatcaattgaaatttgtactacgtgaagaacaaagtacagtggaagcggcaacagaaacaaattatttagaggcaactacacaggcagtgacgaatgcgacgcagcaatttcagtcagttaagatgaatggaatctatgagagcctagataaagctgatgatatctatatatactcaacagggtgggaacaagaaatcatctccgaacaattgcaaagaaatttctttttagccggaaaaaaagtttattctcttcctgcagcggtggatgaattagaaatggcattacagcgcatgaaaccagatgatttgttaatggtgatttcatacagcggaaacaataaacaattgttaaaaagtatgcggcatgctgttgttcgtggaatttcaactttgtcttttacgccctttaagcaaaatgctcttgctgaaatgtgtaaatataatttgtattatagcgtggtagaaaaaaaggtttcagatattaaaaatgtggaaatctttttcacaggcttgtatgtgctaaatgatttgttagtaatgggttattcagattacctaaagaataaatagatgaggggtaaaggctatgacaacggcaagaaacggtatggttacaagaattggaaaaagagtaatacattttctgaattataatgcaaaaaaagcacttaatgtatatatgagtatgctcggactgttggcacttgccaacgttgcctatatatcgtttttagctaacgcaacacaagtgacccttagagagtttttagataaaaatccaataaatacggtcatgctgattgtttcaacaatggatgtcatagtcgcttatattctttggatggagaaagacaagctcttagctgaccaacgtaaatttcagggaattatagtttatttaagtgttctacagttgttagtgggtaatctactgtgttttgtccttggaatgatcacattagttacaagtaaagacctgccattaaaaggcacaaagtacattagaaataaagatgtttttccattaataatgggagcagtaatttatcttttttgcttattcttacttttgaagttagcattttaaaataataattaatggctacagtgtggaaatcaggaggtaatgaagatgtttggatttggaaagaaaaaaggacaaaatgtggttgctgcggttaacggtaaacttgaaccaatcacagatgttccagatgatgttttttctcaaaagatgatgggagatggatatgcaattaacccttcctcaaaagaagtttatgcacctgtaagcggaatagtctctactgtttttccaacaaaacatgctattggcatcactactgataaaggtttggaagtcctgattcatatgggtcttgatacagttgatttaaaaggtgtccctttccaaagccaagtaaagcaaggacaacgtgtgaatgaaaatacattactttctgaaatggatgtagatgccataaggaattcgggacgggatgcaacagttgttattgtttatacaaacatggatttattaaaagaagtaccaaatatttctactacagagatccagcatggagatgaggttggtaagctacaatataaataatgtaataaggtcgggatagtatgtcagaaattgtggattcaaatagtttcactttgaaagattatggtataaatgagctgcttagcaaagatgcaatgtatatttcttggctggaggtcgaaaaagcgattgcaaaggcgcaaggagaacttaatattattcctgtaggaatggcccaaatcattgaagaaaaagcgcaatatcaaaacattgactgggaaaaagttaatgcgttgtatttaaaacaaggacacagtttttatccttttgttgaagtgcttagttctgcctgtgaggaggctggcaagtatgtacatttcgggataacaactcaaaatgtacaacaaactggtgagttacttgtttcgaaggaaattaatagtagatttcttattatcatttcagatattttggaaaatcttgctgaactagctaataaatacaaagaaacattgatgcctggtagaacacatggaagacatgcagttccaatcacctttggattcaaggctgcaacttggatttcagatattttgggggcaactcagcgattgaagagctttcataatagtggatttacttccatgtgtggtggagcagttggtgcgtataatgcacttggagaaaaaggacctgagttaaataatcgagtcggaaatattttagggttaactccaatggatgtgccagccaggaatatccattcaagtattttggagtacattaatgagttagctatgctggtaaatccacttaacagaattgcggaagaagtatatatcacttctgttgaggaatttggggaactatctgaaagctttgttgcaggtcaggttggtagtagtacaatggcccaaaagatcaatccaaagttatcaaaaggaattatagcaaattctgagaaactatattcaattgtgagttcgttatattatgcttcagcacgtccctttgaggctgatagttctactaatatgttattagatgatcaactacacgaagcattgggacttgtaaaagaggttctaattagagcagaaaaattaactgctacattagatgttaatgttagtaagatggctgaaaatgctgaaattaccaatggtttagataatactgaaaatatcatgatgaatctagccagaattattggaaaagctaatgctcataaagttttgtatgaaatatcaacagaagcagagcgtagcaaatcaaattttagggattgtatcttaaataatgaagaattaaataagcatttcaaaaaaaatgaactaataaacatgttagatccaaaaaactatataggattatctaccgaaattgctgttagtcaggcaaaaaaggcgaaggaacaatcctttattctgaaacagttatatatgaatgagtaggaggaaaaaattatggaaaagcattggtggcaagaggcggtagtttaccaagtatatccaagaagttttcaagatactaacgatgatgggattggggacttacaaggtgttctacaacatctggattatatcaagagattgggtgcagatgttatttggttaaatccaatttattcgtcaccaaatgatgataatggttacgacattgcagactatcgaaaaataatgacagattttggaacaatgaatgattttaatcatttactggaagaagctcataaaaaagggcttaagatcatgatggatctagttgtaaaccatacgtcggatgagcatcactggtttatggagagccgtaaaaataaaactaataaattccgtgattattacttttggcgtgatccaaaggatgggaaggagccgaataattggaagagtaactttagtggtcctgcttggaattatgatgctaaaactggtcaatactatatgcatttgttttcaaaaaagcagcctgatttaaattgggataactctattgtgcgcaaagaagtttatgatcttatgaaattctggttggataaaggtgttgatggttttagaatggatgtcattaatttaatatctaaaaagccaggactgccagatgatcctaatgttgctaaaagcgaagttgaggatgcaatggaatgggttgcaaatggacccaaagtgcatgattacttgaaagaaatgaataaaaaagttctttctaaatataatgttataactgttggcgaaactccgtcggcaactccagatgatgcaattaaatatacaggtttcaatcgtcatgaattagagatggttttccaatttgaacatatgggattggattggagtaaaaatggattaggaaaatggagtaccaataaagtagctttaactgatctaaaaaaggtaatgtcgcgatggcagacagagttgaacggtaaagcttggaattcgttatattggaataatcatgatcaaccaagaatagtttcacgatttggtaatgattcgaaaaaatatcgtgtcttatctgctaaaatgctaggattactgctccactttatgcaaggtactccgtatatttatcagggtgaggaaatcggaatgacgaatgtacattttgacaatattcatgaatataaagatttggaaactttaaatgtctataaagaaatagttgaagataaaaagaaagtttccccaagtgagatgatggaatacattcatcactcttcacgtgataatgcacgtacacctatgcaatggaatgatggaaaaaatgctggattttctgaaggaaatccttggattaaggttaatccggcatacccagagatcaatgttgcaagtgcgttagaagatacaaattcaatttattacttttatcaaaaaatgaatgaattaagacataaatatgatgtgatagtttatggtaattatgaattgctagatccagatgatgaaaaagtttttgcctataaacgtaatttaagaaatgaatctatactcgtgatagcgaactttacggaccaagaagttagcagaacatatcaaccttataatgattttgactgtaagcttgttttagataattatgacgatgatcagaagttaatattaaggccatatgaagccaaggtttattattatgaaagataggtaaaatgcagacattagaatgttcatgataccgactaagcaaactattgttgcctggagagaactaaattaagcagtagtcatatttcctttgtttaagtttttgcaaatgatgacaacataaaagcatcccccaaatgaagttaaatcttcattttgggggatgctttttccatcaaaaaatcaaacatctaaactattgctgctcaaggaattattgataacaatcaccccacctttatcatatcgatggcgcgtttgagaatattcaaaagctcgtccatccgataaatgaaccgtttgagagacctgtaaaataggttctccatggttacattttaaatacttctggtcattcttctgaggagtgtcggctgtgattttacgaattgaacttccaatttttaagttgagtgttgattcaataaatttgtaaattgaaccgctagcaatttcttctgttaagttttgaattactgaaaggggcattatcgaatgatccaattcatatggttccttatcaacatttcttaaccgcagcacatcataaactggtgttgaacttgagattgcaagtcgtttttgttcatgagggttaggtaatctaatttcaaagttcaaaacttgtgttgttactttgttccggccttcgaataatttagtggtcccctcatactgactagataaaatatctaaagtagattgagagttaggagctacagtggttccacttccttgacgacgcagaattaaattggcgtttgataattcatcgagcgctttttgaatggtaacccgagacgtgccaaattcatcagccaattccttttgactaggcaaatgttgaccagtttcgtagtcaccagttttaattctattttttaaggtagttgcaatttctttatattggctgatagttagcaccttctttttcacttttaattttagcatagtatttaaattatccaaattaaatagttgagttttcatattaataatttgactttacaaattattaatatgagttataataaaatcgttgaggaggttaacaatggaaaattcaaattttctctggggaaactcagtttcaagtatgcaaacggagggtgcctgggataaagacggcaaaggcccatcagtttatgatgtaagaaaagcaacaccggaaacgagtgattggaaagatggtattgatgaataccatcgatacgaagaagacttcgatttaatgaaaaatgctggaatgaattgttatcgcttccaggtttcttggtcaagagttatgccaactggagatggatcaattaatcaaaaaggattggactattacgagcgtttcgttgatgaattacttaaaagagacatgattcctgtgatttgtttgtaccattttgatatgccgcttgctttagcgaagaagtataacggatttgttaatgatcatgtgcgaaatgctttcgtccgtttttcaaaaatcgtcattgacaaattggcttctaaagtaaaatattggattccttttaatgaacaaaattgcaccatgtttgaggagggatttcaaaatagtggttacttgcaaggcgataagaccatcgaagaccagtataaaattgccaccaacagtctaattgcatatgcggaagtcacagattatgttcataaatttgatggcttgcaaattggtggaatggttgcctatcaagaaatgtatcctaattcaatgaaaactcgagatgtgatggttactcgcaaagcaaatgaatttattaataatgactttttatcactttttgcgactgggaaacgttcagcagaagttattcaatatatgaagaataatggcatgacaacgctagttcaaaaattaaataaggtgaccgaaaaattaaccaatataaaaagtgattttttggctttcagttactattacagcttagttattgattcaacaaggatccagcaagatgtagcgcctaattattatatgagccaaggaaaagtattgaatcctaacttggaaacatcagaatacggttggcagatagatgctgacggttttagaaatagtattacagaaatgtctgatagatttggattgccaatattctctgtagaaaatggaatcggcgcaaaagaagaatgggatggccaaaatcagatcgatgatgattatcgtattcaataccataaagaacatattcaggctatgaaagacgctattcaaatcgatggtgcacaagtaatgggttatcttggttggggcctgattgacattcctagttcagcgggcaatatggaaaagcgttatgggctagtttatgtgaaccgtggtaatcacgagctgcgagatttaagaagagttcccaaaaaaagctattattggtttaaaaaaatgatcgctcaggaaaaattttaaaaaggagtgtagatatgaaaaaaagtggaattggaaagaagtttattgacagttttactaatgtttctataaaaataggtaatcagattcacctacgttcattgcgggatgcatttgcgatgattatgccgctatttattttagctggacttggggttctcgttaataacgttatttttacgttattctttaaaggcacaaccttagcaaattttcagacatttggtaatttattggtgaatggaacgcttaatattgcaggattattgattgctcctgtagttggctattgtttagcaaagaatcgaaatttcaataatgctttaggtgcagcaattgtctcattggcgggcttgatcgtcatgatgcctattacaatacaagcaattccaattggtaagacagcgcctgttaatatttcaggatatttatcttttacaaatgttggcgttactggaatgttcgcgggtattattattggacttgttgcaactgagttgtttattaggctgtctggagtgaaaaagtttcgaattaacttaggtgaaaatgtgccgccggcagtcagcgattcgttcatgactttaattcctaccattgtagttttgagtttgttagccattattgcagctttattaacagttttagctcatacagatatgattaagctaatcactatccttattcaggaaccattgcggaaagtgaatactagtttaccaggattcttgctgatttatagtgtcggaaatcttttgtttggttttggtattcaccaagcagttattaacggaacattgctagatccagttttattgattaacacaaataagaacatgcaagcttttgcagccggacatgatattccttatatcatcactagcgttttccgagatacatttggtatgtatggtggtacaggaagcacaatttgcttactaattgcgaccataatcttttcaagaatgaaatcaagtcggcaaattacaggtctttctattgtacctgggttgttcaatatcaacgaaccggttatttatggatatccaattgtttttaacttgccgctactaattccctttgtattaacaccaattattgcactattgtttgcctacttttgtacggcagttggttttatgaaccgaactgttgttatggtgccatggacaacgccaccattgattaatggatttcttgccacaggtggagactggagagcaataattgttcaattgattacgattgtatttgggattttcttctatcttccatttatgaaaatctcagaacgcgttatgttacatcaggcggaagaagagaaataatattttccatcgttagaacgaactcggttgagttcgttcttttttttgagtgtcattttaatggttattaaaagtatactatcttaagtgtactttattgaatatttcaaaaacgttccacatggtatattgaaaacgtattcaggaggtgaataaaatgcaagaatctattgaaaatttgacagatcaggaagttcaaatgattaagttgattcttaacacaggaactgttcattattctgatatttccaaaagtattggaagatctcgtaaaactatttcaaaatatttggataacattgaagaatttctccaaggctatcacgttgcccttgtacgcaaacgtaacgtagggatttattttgaaggtgatactacggatcttcaaaatgtgattcaaaataaaaattatccagatacgccaaatacgaagaacgaacgagttattgctattttatcaaagctattacttgcgaattatccgcaaacaattcaacagcttgctgatagcacgttcgttagtcgtagtactttagaaagtgacttcaaagaagttaagcgtacattagcgaaatatggtgcacttattgaaaccacgcatgatggtatgcagattgttgcatcagaaagttcaaagcgaaagctgatgtcagagctgcttaccatgtactggggtaacacaatgtatttggaaaataaggaaggggaaatgcaccgagaattaaaaataccaaatgatatgcgttcattttttagtaaagatatttttaaaaaagtattaagtgcactggattgcttccaacaagttagtccactccattttaccgattatgagtttcaatcattagctattcatttaattatttcgatggaaagaattattaaggataaaacgcttgagaaaagtgaacatccagtgaaactggaaatgaatacagtcagtttgattaacatattagaatccgtctttaaggtttcaattccgcagtacgaacgtcaatacattaatatccacattctagctgctgaaggacagcctataggtaaggataagttagagaaagctgattcaccaattcaacaaaatgtaattcatgaatttcttgcaagcaatattcgtaaccatgatgaagtactccttcgtggacttacagtacatgtgacttctgcattaaaaagactttatctggggttgaatttacataatccatatacagaagatattaaaaagttttttcctctagcgtttaataatgcgattgatatcagtgcaaaaatcgaaaaacaatttaatatcactctgaatgaagatgaagttgcttttattgcactacatttagaagcatatattgagagacaaaaaagcatggttaatgcagttattgtttgcagtacaggattgggaacagccaggttgttggaacaaagggtcaaaaagtatttttcagatagtatccaaattaaccgggtgacctcaattcaagatttaaaaaatcgtccaattgttgaagatttagtaatcagtaccattagaattgaagttccggggactcctgttgtggttgtgccaccgtttcttgatactggatcagctaatcagatacgaagtaaagcaactgagattttggaggatcggcaaaattcaggtagctttagcagattgcttgataaaaaactaatattctttagtaaagaaaaagaaaatcgggaacaagttatcactaaaataggagaaacgttacagaaacttcggtatggacgaaaaggaatttctaaagcggcattagagcgagaaagtcttgctagtacagcaattgataatatagcaatgccacatgcaccaattgagttcgttgctaagccttgtattgcaatatatatcaatccagccggaattaggtggcaaggcaatacagtgaatgttgtgtttttcttagcaatgaatcgcgaagtgcaaactcaaatcgaacaaatttataaatattttaatgacgtgctagagaataaaaagctgttaaaggagattgagggatgcgtgaaaccacaagaagttttaaaaaaattaggaggtgatttgattgagtaataaactaagtgattttatttcagagaaaaatatcgtaatggatttacatgccaagaaccgagacgaagccatccaacaattggctttgattttacaaagaaatggaagcgtttccgatgctgacgatttttatcatgatgtattatatcgtgaatctttaacaacaacaggaattggtaacaacattgctattccacatgggaaaagtacatcagtgattcaatcaaccatgttatttgcaaaaaactctgaagccttagagtggaattctttagatggaagcaaggtcaatatcatctttttaatggctgtttctccggaaacacaaggagatgagcatctaaaaatgctagctaaattgtctggaaaacttatggacgatgattttgttgaagcaattaaagcagcacaaacatcagaaaatatattaaaaattttaaaagaataatttttggaggaacttaaaatggcaaaaaaaattgtagcagtcacagcttgtattgcaggtatcgcgcatacctatatggcggctgagaatttaaagaaatttgcaaaaaaagaaggttatgacattaaagttgaaactcaaggggcaatgggtgttgagaatcgacttgctcagtcagaaattgatgcagcagatgttgtgattttcgcagttgatacaaatgttcaggaaccagatcgttttgaaggtaaaaaaactttaaaagtagggacttctgaagttgttaaagatggcaaatcaactattgatcaggcaattgaactaacaaattaaaagggatgtggaaataatgaattggaaaaaatttggtaaagagttagccaatcattttcaaactggcgtttcatatatgattccactggttactgcagctggtctattaacatctattgcggtaatttttggaggacaaaatgtttggaaccaaacaagtaatatctgggggaatcttaggcttttaggacaaacaggattaggatttatcccagtaatcattgcggcttatatttcattttcaattgctgaccgtcctgggttagcgccagcatttattgttgggttagttgcatcttcaatgggaactggatttttaggtggcatgttagttggattattggttggatatttagttcagtggcttaaaaagattccaatgccagcaaatttaactgccgttaagtcattaattgttatcccatttatagcgacattagtggtcgggctgttcttgatttatgttgttggtgatccgattaaagcaatgaccgtcggattaactgcctggcttaaaggtatgagtggtgctaacgctgttttgttagctgcgttacttggcggcatgatggctgttgatatgggaggcccagtcaacaaaatcgcttatgcgtttggtatggccgcatttacttcaggtggatatcaagcaagtacagcaatgctgatggcaatcggtattccaccattaggtatgtttgttgcaaccttgcttggaggtaagaagttatacagtgatgctgaaattgaaagtggacgttctgctttagtgatgggaattgttggaattacagaaggtaccattccatttgcggtagcagatccagttcgagttattccaagtattatcgtaggaactgcggcaggttgtgcgacaaatgcattctttggaacatttcagaagaccgcactttcaacagtgatggcaattcctttctcatcaaatgcaattctgtatacaattgcgatattggttggtgtcataattacggcactgttggtaaatttcttaaaaagatttacacgacataattcggaaacggaagaaggttaatttatgactcaaacgaatctcgttaaccatactcattgggatcgagagtggtactttacaactatggatgctttggtattgagcgatcaactgtttaccgaggttctagatgagctcgaaacacacgaagatgctaatttctgtttagatggacaaatttctgttgtagatgaatttgtagaaattcatccagaagcaaaaaaaagaatacaaaagttagttaaagagggacgactgtttgttggaccctggtatacgcagactgatgctttaattccagattcagagtctatcatacgaaatttagttataggaattaatgatactaaagaaaaatatggacagcccatgatggttggataccttcccgatacttttggattcaatgcacagctcccaaccttattacatcaagtggggattgataattttgtgttttggagaggaactaatttcagaacacaaatgaattctgtttactttaagtggaaggggctttcgggaaaagatgtgtacgcagctaactttccatttggctattttacagcgcagattgatgtagaatcaaagcgtaaacttaaagaatttgtaagcaaacggtttgatccggcagctgattttgaagcaactcatgctaaaaatgaagatgttttgatgccttctggaattgatcagatgaatattattaagaatattcaagagacagtagatgatctcaacaaactgagcgaaaatcatacagtgatcagttcttacccagagtttattgataaattgagacaacgtgccgacttaccaacttatcaaggggaacttcgtttaccaacatattctcgagttcatcgtacaattggttcggttagacaccagattaaaacggataacttttacttggaacaaaaaattctacgaagaattgaaccactaatggttattgctcataaaaatggtgtcaatattggtaatggattgttgcttaaactttggaaaaagcttttggaatgccaagctcatgatactttaggtggtagtgtttccgataacgttgcaatagatattaagcatcgtttcaaggaagccaatgaaattgctgacggtattgagaacatgattaaaaagaagttggctgagtttttaagtcttagcgatcatgatgttttagtatttaatactgatctaactaagtttcagggcaagaaaattatcaatattattgctaattcaaaaaatcttgaatttgatggtttagaccatccggttattattgacagtaaacactatccagttcgtcatcatattttgatgatgacaccaagaggacaagaatataaagatgaacccgaatactttgaattgaaatttgaaggtgacgttacgttaccagcacttggttataaggtgattcattttagtgaagcagataaggcagcagatgagttagtaatcggttcaaataacagtaatacaattcaatttgaagatcaaaaattgagtttcactgatgacacattgaattacacaaataaagagcaaaggcttgataatgtagttcaactgattgattcaggaaatgatggtgatacgtacgattattctcctcttaaagatgaccaagaacgtgtgcttgattttcaagatgctcatgtagaagaagttaacggagatgcgaaggtattgattgttaaaggagcaagtaaactacctttacacttagaagacagattagctgagcagccgcaacgtcagtcagtaagctatgtgctaaggttatcatttgatgaacatgggttgttaaacggtcatttgagttttgataatcaggtctattcgcatcgattgagattacgtataaacccacagatttttgagggaaaaacaattgcacatattcaggacggttttattcaaaccaccaatcataaaattagtgatgattgggaaaaagaattcgtagaaaagcctgtaaatatttatagttttgataaatccgtttccgtaacaaacgataatcgacaagttactttctttggtaaaggcatgaaagagtatgaagaacgcaacaatagtttgtatattacgctgatggcaacgacaggtgaacttggcaagccaaacttggcttggcgaccagggagagcatcaggtgatactactaaccaaggacacgtgatgatggcaactcctttggcagaagagctaggtgaaaatgaatttgaatttgccttaggatttatagaagaggcattttcagaacaacaagttagccaacagatgcatgagtggctttcaccctcaatttcatatcaaatgcagaagctaaatttgtttatcaatcggcttgataataagatttgggaaacagaagacaatccgttgattccaagttcgttctctttactggaaattgataatttattgatatcggcaatttatccatcttaccaagatgaagatgcctatattgtcagaattcaaaatccaactaaggaaagtgttactcttccaaaaaacttactgaagcaagcaatcattgtgaatgctttggaggatccaattgaatctgatggaacaattggcaaatatgatatggtaacacttaagatcaagtactaaagaataagcagagaatattcaaaaggtttaagattaaaaaataataacgctactacaatatttttaacaaaagagaattaggtgaaaaatcaatttgattttttacttgattcttttttactagtccaatttttgcaacattaatctagtaaaagaaagcgtttgcagaaaggcggcggcattttatactagaattaaagttaaaacgagaaaggaggtattccaaaaagctaatgaatgagcgcgaaacagaggttgttcgatatattttattacaaggaaaaacccattacgaagatattgcgaaacacatgaatctgtcacaaagaacgattgcaaatgtactagaccaaattgttccaatggttaaagagttggatgtgaaattggttcgtcgaccaaatgatggaatttactttaaaggagatcttgataaactacgaaatgatcttagtttatcctcatcaagtagctcacagtccaagggaggtcgccagcgatatatcttgttcaaacttttactgaactccaattcttatacacttcaagaccttgcagatgaactctttgtcagtcgaagtacagttgaaaacgattttgtagccgttcgaaaaaagttgaatagtatgggaattggtgtggaggtgagccaccaaggtataaaaatttcggcaacagaagaccaacgacgtggtgcaactgcggaattaattagtcaatattggggtcaagatatatatgcggaacatgaacatggtcaattagtgagaacaatcaatttaccgccaaaattacagcaattattttctaaaaaaattattacattggttatggattctttgaccgaattcatcgataagagtcatttgaccttttccgattacgaatttcaatcattagctattcatctaatgattgctctagaacgaataaataattcttcaaagaatgagccacagtctgcaaaaactagtaagtacactgggttattgagtgaaacaaagctgttaatcaagattcttgagcggcgctatcagcattcaattccgctagttgagcagaaatatctaaatttgcacattgtggcagctatgcacaaaaagatttcgctgtcagatgtgaaagatgagtcagatcaacaaaaagttgacgacgaatttaaaaatgtttctgattttttacaacaaaaattggtagatattgaaccagataaagaattgctagagggattatcacttcatttagaatcgactattaaacgactgaaagttgggcttaacatctataatccctacacgaaagaaattcgtcgtaatttaccagaggcctttgatgcggcagtcaggctacaatcagatgttcaaaaaacttatgacattgttctgaatgatgatgaattagcatttattgcattacattttgaatcattttacgaacggcatttaaccgataaacgattgagagtggttgtggtatgtagcagcgggattggaacttcacaactgttggcacaacgattagaaacaaagtttaataaatcacttcaagtcatcagggttacaacggtagctaatttgtttaactctgaactaactgaagatttagtgattagtacaattccaattagtaacttggataaaccagttgttagcgtgggaccgctgttaggaccggccgacataatagcaattcagtcagtaattaagaagttacaaaaaagtgagcaaccaccaaatccgttttttgaattattaaaaccagaactaattatagttaaatcaaaagcagaaaattattcacaggtcatgaatacaataaccaaaaaattagtagaaaatgactacatcagggattcaaaccaagttttaaaagccgcggacgagcgcgaagcactagcgagtacggcaatggataactttgcgttgccacatgtaaatcctaaattgattcaaaaatcggctcttgcattgttgatcagcgaaaaaccaatattatggcagaagagtgaagtgcattttattttcttcattggtttaaataataaagttaaagggaagatgcgagaaatatttcagttgattaatgcaattattgatgatcatcagttacaaagccacttattaaaggctaaacaatcaaaggaagttataaaaatactaaaagattggaataaaggaggactttagattgaaagagtttgatttaaacaacatatttacagatattccagtatcaggtaacaaagatgatgcattgagtaaaatggctaagctgtttgcgaaagaagatggaatagacgcagatgagctaactcaaggattcagggcacgtgaacaagagagtacaacggggtttggaaatggtgtcgcaattccacactctaaaattaatggtttgaagcaaccagtagtgggaattgtcacttttactaaaccaattgagtggcaatcattagatgaaaagccagttgagattgcaattgcattaatcatgcccttagatgatccaaataaagaacatttaacagtactgtctaagctggcacgtaaactaatggatgatgagtttattaaggaacttcaggatggtcggcacgatgcaaatagcctgtacaaggttgttacaaacgcaattgattttgagtcataaaatatgaaaggcagtgaaacgatttggcaagttttgtaggagttacaaaatgtcctgtgggtattgcacatacctacatggcagctgaaaaattacaaaaatcaggtgaggccaaaggctatactgtaaaagttgaaactcaaggcgcacaaggtaacgagaacgaattaacagaagatgatataaagaacgcagattttgttattttggcaattgatgttgctattgaaggtatggatcggtttattggtaaaaaagtattactagcatcgaccgcgaatgccattaaggattctgacactttaattgcagatgcccaaaaggctaaagtatatagtggtgacaaaaaatctgctggtgatcaagaagaacaaacagaagagactgatgagcacaaacaaagtcccattgtgcaacagttattaaatggtgtttcacatatgattccatttgttgtagtaggtggcctgtttattgctttggcaactacatttggtagtcatgcaaccagtgccggcatggtcattgcaccacacactatttggagtgccatgaaccaaattggtacaattgggtttactttgatgataccaattttagctggatatattgcttatgccatttcaggacgagcagcgttggctccagcaatgatcagtgctatggttgctaatacaccagctattttgggaacaaaagctggtactggatttattggtgcgattgttgttggttttgtagcaggctatttggttaaatggttcaattcatggaaagttcctaagagtattcgtccagtaatgccaatatttgttattccactgttaggaactggtattattactgctggatttattcttatcttaggagctccaattgcttggttaatgacttcattggaaaacctattgaacttcttatccaaggatccatcaaccagtattgtattaggattagtattaggggcaatggttgctgttgatatgggtggtgcgattaacaaagttgccttcctgtttggtgttgcctcaattacagctgggcatcctcaaattatgggtgctgtagcgtgtgcgattgctgtcccgccactatcagttgggttggccacatttattcgcagagacttaaatactgatgaagagaaaactgctggtattgctgcaattttgatgggattaattggtattacggaaggtgcgattccattcgctacagccaatccaaaacatgtctttccaagtattataattggatctgctatagcttcagcggttggaatggtatttggaattacagatgctgtaccacatggtggcccaattgttggtgtcttaggtgctacaaataatattgtcttgttctttattgcaattttatgtgggattgctgtatcaacaacaatgcttgccttcttcaagattcgtaaggctaataaagaaaagactcatgcaaaagttgcctagtcatttacaattttagtcttacaacaaaaaattaatttgaaaaatggtgtatttaagcattctctaattaaataacaaaagaaattattagttatttgaatatgatagataaccaaaaatttggctaagatgttgattgaactagtggctatataaacagtttcaaaacgaaaaaagctatttacaatgaaaaactcctttgtaaatagtctttttccgtcacaaaatactattcttttttaaagcctacttgatctggtaaatctggagttccatacatttttgacgtgactggttttaagttaggggcactggcttcgggtttaggatccttgacccatttaaatttaccttcaccgtctaaagcttccccttttgcccagtttccatcttggctttcttcaccctctgataaattgtaaaaatcataagcaatgtcaaaacgttccttgtcacgtggaaaagtggttgggactaagattccgccttctttttcttcaagttcttttacagcagtcatccataaattctggtgataactatcacgagcgaggagaacagacagtaactcacggacacctttgtcttcaatcatttcgtaaattcgagcgacctgtaatcttccttgagactcagcattaagattagcccgaaaatcagcaagtagattaccactggcaataatatacgcaccactccaagggttaccaacgctatcagcggggcgtggacctaatcccgccacaatcgcatgttgggggttcatccctgatataattgccttcacagttggatcttgtttcatgacctcttcttgttgaatgataggagcgtcttcaagcaagcgggcaaccattgtggccaacatttcaacgtggcccaattcctcggttgccacgtccataatcatatctttatatttttcttctccgcggcaactccacccctgaaacaagtactgcattgcgacactcatctcaccatattgcccaccaattaattcctgaatatatttagcatataacgggttaggcgcatctggtttagcttcgaactgtaattcttttttgtgattaaacattattaagtcgcctccttaatgctaatatctaataattacgattagatatcaaatttaatgaacgtgaaatttaaaacgcttaagtttttctgataaataaaaatctcgacagtttcgtttacccaatgactactgaatttttgttttacaacaaacaaaattaatttaaaaaaatgggtatttaataattgtaagcttaaaatgtatacatacaaagtatttacttaagctctcgaaagtatgtataatataaatattaggaggaaagatatgcctaaacggccaaaacagcttgaaaaagaaatcttaaaggctggatttgtcgccaaaaaggaagagggaagggtggacatcgaagatataaacacccagatggccgaactgccgaaattccgtttcacgataaagaactgagaaaaggtactgaagaagcgattagaaaacaagcagtgttaaaatgaaactcattggcatatctaaacagaaaatgaataaagtaatgtatccggtaattatttcagaacgtaatgatgatggccgttattttgttgcgacttcaccaaatataccagggatggtcactcaaggtgacacgttctcgaatgcggcttactgggcggaagacgccattgccacaatgttggacggtgaaacagcttatcctaaagtgcaggatccaagcaactggaaactagcagcaaatgaacgccttgtatacatcaccgttgacatgaataagtggcttaaaaagaacgccaaaacaattaagaaaacgatcaccgtccccgagtatttaagtaaaatggcaaaggagcaaaatatcaatgtttcaaaagtggcaagtgatgcgctcaagaaaattttaggtgtttaaggttttctgataaataaaaatctcgacagtttcgtgtgatttaacacacaagaggctatcgagatttttaaattaaattgctttttcgagttttgcgtaccaatttttacttacaaatgcggtccaaactagtgttgcgaagcttggccgatgtcgatggtgcttgcgtttgattgtggggtttatagctgtgtttacgtcttgcataagttatctcccttcatgaattacaaaagttaattggtgatttagttgatagtttcttgggacgctagatcgaagaaatgcgcgcgactcatatcaaatgccaattgaattttttcatcaggtcgatgactattttgtgcattcaccttagcaacgaattcatgcggtcctgccataacgtaaagcatggattctacacctagcaattctgaaacttctactttcgcattgacctgtgcaccagcaaacttttgcaaaaggatttgatctgtgtgaatgtcttcagcgcggatccccagtgtgattgtttttttatcgtagcctttgtcgcgtaagatggccagcttgtctggcggtacctgaacatcaagtttcttatctaaagtactgactttatcatcgtgcaattgaacttcaaaaaaagttcattgaaggggatcccatgaaaccggccacaaatttattgaccggttggttgtaaagctcagagggagttccaacctgttgaatggtcccctgttttgttaaaacgattcgatccgccatcgtcattgcttcaacttgatcgtgagtcacataaatcatattggtttttaaacgttgatgtagttgcgcaatttgggcacgcatagagacccgtaattttgcatccaaattagatagaggctcatcaagcaaaaacagtttggctttgcggacaattgcccgacctaaggcaacgtgttgtctttgtccaccagatagggcggctggtttacgggttaaaaaatcctccaggccgagtatttcagcagcgttatcaacccgcttttttacttcagctttattgatgtgctggatttttaaactaaatgccatattgtcatagacggtcatattgggatacagtgcgtagttttggaagaccatggcgatatcacgatcttttggcgcaacatcgttaatgactttgccatccattttgagttcgccatctgtaatgtcttcaagaccggcaatcattcggatggtcgtcgatttaccacatccggaaggaccgacaaatacaatgaattcctgatctttaatgtgtaaattaaaatcagtgactgagtaattatcatttccagcatattgtttataaatatgatccaagttgatttcaaccattatttaagcctccgcttataagaattaactaattcatatcagaagaatatcagaatacaacggtctcatcaaatgatttgactatcaagataataaattatatttatagatgagcttgaatataggaactttaaaaatggtttaacaatgcctaagacttagtacaatagcgtttaattgaaaaatgcaaatgaagatgtataaataaacttgaaagcgctgttacaaaaacgtaatattcagagctattaggtgagaattatgtgaaggagattttaggatttcaagtaattagaaattcaattatgatatgataaacctatatagaaaaagaaaggggtttataaattgaaacaatttgaaattaaattatcttatgaaaatgggcgcgttattacgttctatcgggaatttgccgatctcgaagaagcagaagaggacgttttggctcacatttcctctggctcaacaattaaattcaacgaagctggagcagttggcatgctgtcatttcgcggggccattagctatttgattacgcaaaaagatcgtccaaacgatgttgaggcaattacctgggactagctcgcagcttataaaaggggttaattaaatgagcgcagaaatttctgtacagagtttagaaaacggttacaaaaatatttttaaagaatcaccagcgcatttttactttgcacctggacggattaacttaattggagaacatactgattacaatggggggcgcgtatttccttgtgccattagtttagggaccttcgcagccgtcaaaccacggacagataatgaatttcatttgtattctaaaaacttcgctgaccaaggtgtccaagtttcaacgttaggaacttctgaaattcaagaaaaagtcggcaacatgtggacgaattatccaaaaggcatgttgcgctatttgatggaagatggtgcaaaaatcaccactggtttaaatgtctacattgtcggcaatctgcctgatggcgctgggttatcatcttcagcttccttagagatgttatttggcaagattttccaagatgaatttcagttgcaagtggatccgattgatatggtgaaaactggtgtgaaagttgaaaatcagtttatcggcctcaactctggcattatggatcaatttgctgtagaaatgggcaaaaaagacaacgccgtgttgttggataccaatacccttaaatatgaacacgtgcctttgaaactgggcaattatgtcatcattatcatgaataccaataaacggcgggagctggcagattcaaaatataatgagcaccgccaacaatgtgacgaagccttgaaacaattgcagactggcgttgatacgccaactttaggtgccttggataaagaaacctttgatgagtatgcttacttaattcaaagcgaaccgctcctcaaacgggcccgtcatgctgttttcgaaaatcaacgcgttggcgaagcaatgactgctctaaaggatcaagatttggccaagtttggccgtttggtgaacgcatctcatgtttctttacagtacgactttgatgttaccggtaaagaacttgatactttggcccacactgcttggcagcaacctggagttcttggcgcccgcatgattggtggcggctacggtggttgtgcgattgccatcgtggaaaaagatcaagtggctgtttttgaagccgaagttggtaaagtttacaaagaaaaaattgggtatgcggccgatttctatgtggctgagattgccgacggacccactcaattacgaagaggtaagtaagagtgaaaaatgaacctaaattagtcgatcaatttgtggatgaaatcctgaaaaggggtacctatcatgaattggaccggcgctatttgattaaccgaatttttgcgttggtcggtgaacagtcattgacgtctaaacaaaccgccgttgatttgttgcagctgcatgatttgttgattgaaacggccatccaaaatggcaagattcaagataacccaacggaacgggaaattttaggtgctgatcttatggacttcgtgacctcaacgccttatcaagtaaatactaagttttgggatctgtatcaaaaaagcccgcagtcggcgacgggttacttttataagttaagtcgtgaaaatgattatattaaaacacgggcaatcgccaagaatattgagtttccagtgccaactgactatggcaaattggaaattacaattaatttatctaaaccagaaaaggatccacgggcgattgcgttggctcaaacgacggtttcaacgagttatccgcagtgtcagttgtgcatggaaaatgaaggttacgagggccgagtcggctatccagcacgaggcaatcaccgaattgtgcgcatgcaattggatggagaaacgtggggctttcagtattcgccgtacgcttattttgcggagcactgcatctttatttcagatgagcatcggccaatgcacattgatcggcctacctttcagaacttaatggcgattgtaaaatactttccagattattttgtcggtagcaatgcggatctcccaattgtgggcggttcgatgctgagtcacgatcattatcaaggtggtaagcacgagtttccaatggcggtagcggcagttgaaacaccgtttgaattgacagggtttgcgaatgtttcggccggtattgtgaaatggccgatgtcggtgattcgcctgaagagtgggtcagaatcgagtttagtggatgcggcaaccaaaattttaagagtttggcaggaatatgacgatcctaaacgtgatattcggcatgaaactgagggggtgcagcatcacaccattaccccgattgtccgaaaacgcgcggggcgatttgagatggatttggtgttgcgggataatcaaacgtcaaaacaatacccagacggaatctttcatccgcatcaagatgtgcaacacatcaaaaaggaaaatatcggcctgattgaggttatggggcgagctattttgccggcgcgcttgaagactgaattgcaggaagtggaacgctacttgttaaaccagcctaataaaatgaaaacctaccatcaaacatgggccgaacgtttacaagctaagcatgatttcacggcagcaaacgtcgaacagattgtggatcaagaagtgggccacgtctttttacgtgttttggaggatgccggagttttcaaacgtactccagatgggcaagcagggtttaagcagtttattcaaaaggttaacgcaaccgaatattagccaagacgtgaccagtttcatagcaaaaactgtaagccctttactcgttgaaatgcctaaaagatgttaaaattaggatgttaaataatatgcaattgggggaattttaagatgagcgaaagccgcttagatccaaaacgattttcaaaaatattagttggggttgatgattccccagatgcacagttggcatttcgatttgcgatgaatcgagctaagcaagacaatgccgaactcgatattgtatccattttagaacaggatgatatcaatatttatcaggcattgaacaaggattacattttagacaaacgtgatgagctcgagaaacatttacagggttatcgcaaaattgcggaagaatttgggattcgcaaggttgaaacctacactgctgaaggtgatgccggtgaaacgattgtaaaagacgtgattccgcatgttaatccggatttgttagttattggttcttcttctaagtccggagttgcccgctactttggtagtcaggcttcctatatggcaaagtattcaccagtttctgtattggttattcgttagtttaagagcgcttgaattttagtttgtaagtagttagaatgattattagaagcaaataattctaaaagaaggcttaaaataatggcaaagcaagtttataacgattatttttttgatgagccagcatggaatacgcatgatggcggatatgtgccgcttgaagagccgacgacaccgcaacgaaagctgcatgtaccagcagttttgcagcctgataaggaaaccgacacggatatgtattacaccgtgacggccgaagagggtgaaacgcaattattaccgggtccaaaaacgaaaacctggggttataacggcagtttgttaggtaaaacgattatcttcaaacggggaaagaccattcatatcacgttgaaaaatgatctccatgaactgactacctttcactggcatggtttaaatgtgccggggccatatattgatggcggctgtcatgcgcctgtttatccaggtgaatccagtgacattgaatttgtttgcaatcagccagcggcaacgctttggcttcatgcgcatccatgcccatcaactgcccagcaagtttggcacggcttggcaactccagtagttgttcaagacgatgtggaatccaaattacctttaccacgtaattatggcgtggacgactttccactagttttgcaagaccgcaatttccacgaggataatcagtgggattataaggcagattatgatcccgatggcgttcagggtaaaaccccaatgatcaacggaacgatcaatccttatattgatgtcacgacccaacgtgttcgtttacgtgtgctggatggtgctaaccggcgggagttccgtctgcattttaatgatgacttggagtttgcccaagtagcttctgatggtggtattatgccagagccggtctatttcactaaagtcatgctgacctgtgccgaacgggatgagtttatcgttgatttcggcaagtatcacgatggcgatgaagtggcgttaatgtcagatgatgtgccgttggttcatttccgcattcaccaatttgccaaagacgagacaaagttgccagatcatttggttgatcaacctaatttgaccgttacaccagggaccaaaacgcgccatgtagtgatgtctgggatggacgaagaagttgcaattgatggcaagaagtttaacatgcaacgtattgatgcccggcaaaaagttggcgatgtcgttttgtgggatattaccaataccaacgatatggtgggtggcatgatccatccgttccatattcatggcactcaatttttggtcgtttctagaaatggtcatgcaccatatccaaacgagcacggctggaaggatacggtaagtgtcaatccagatgaacatgttcagattaaagtgcgatttgagtacaccggtgtttacatgtatcattgtcatattattgaacacgaagatggcggcatgatggcgcagattgaatcgtatgatccagaccatccaaagacctataaattgatggatatggacaccttgatgaatgctttcgctaaggaaaacaacattgagccaaaagatttgtggctcggtggcatgggatcctatgaaaaaatgggcatgaagatgtaaggctaaagaagttaagtatttcaaatgaaaagctcgtaaaactttcatagagagttttacgagcttctttgcaatcgttgacaaaattaaaatataattgtatagtgtgcttgtttgagtaaacgattactcttaattattaagaaaagaaggtgaaattttgaactacaagctgtctataaaagaaattgcaaaattaacgggggtttcaacggccacagtttcgagagttatcaataataatggtcgtttttctgagaaaaccagaaagaaagttcagaatgtaattgaaaagtataattatgagcctaatcgagtggccaagagtttacgtattaaaaagtcaaatactgtaggaattgttgtgccagatattactaattcgtttttttcaagtacggtccaacaaatcgaggcttatttgtttgaaaaagggtattctacaattatttgtaatactgcgcacgatcaagaaaaagagacaaagtatttgaaaattttggaaagtgaaatggtagatggtatcatcattatttctggcgcaataaactttcaaacaactgaattacatagcaagttacctttagtttgtatagatcgaaatccaaacgataatgatattttatttgtaggatccgaccattatgctggggccgttcttgcaactaagtatctgttaaaaaaagttaatgatataacccttattcgttctgaacgacaatcagtatcttcgctggaaaggcatcgtggatttcaagctacggtgaaagaatatcagaatgtccatgcggaaagctttatttatggtggagatgatcgccaactaaaagtatttttaagtaaaaaaatggggattcatagaccttttggaatttttgcgaatagtgatgaattggctgcaacgattctgttacaggcacatttattgaatattaaggtaccagaggaaatgagattagttggttttgatgatgccccaattgccaaagtttgttatcctcaactgacaactgttcaacaagatgaagagcagattgccaaattagcctgcaatcaattaatagacctaatgaatcatattacaataaagaacaaaacaactattaaaataccagttaaactgattattagaggaactgcctagttttttttattggttgagtaatcgattacccaaattaacaaataaattaaaaaatagaaatgaggtttttgataatgaacttaattaatccttcaatgatgtgtgcaaattttgcggatttggcaaatgaagttaaaaaattagaagacgcaggaattgatatgtttcatatggacattatggatgggcaatttgtaccaaattttggaatgggactgcaggactatgaattaataggacgcatagcgacaaagccacttgatgcacatttaatgattgtaaatccagaaaaatatgtaaaattgttttcagatttgggcgctagtttaatgtatatacacccagaagcagacgaacatccagctagaacaattgatactgttcataatttaggtaagaaggccggaatagctattgatccagatacgtcgatcgaaacggtgagggaactattaccattggtggatgccgttttagttatgactgtgaatccgggatttgcgggacaaagttttttggattttgtattaccaaaactaaccgagatttgtagactgcaaaccaagtatagctatgtagttggagtagatggcgccatttcaccaaaacgtattcaggaattaagcaagctaggtgtaaagaattttattgttggtacttcgtccttatttggtaaaaataaagaatataaagccatcgttcgggaattaaaacaactttagcctagaaaaaatagggtttggcgttacctaattgattatttttgtgatattcaataaaagctatttattttttttgctcaaaatgaaaaaagatgaatatatttggcataatgtggttgcgaatgaataaatatggtgctatactgaatttgtcaaataaatgggagggcttacaatatgaaattagcaacaagaattaattcgtttttaccagttagcgataatgatttaggaaaggtttttaagaagttcaaatcacttgggttgaattacgtagatttaaactatccggaacatgtaaagggtatttcatccgataaaatgaaagcgcttcttagcaacaatgatcttcagttaaatggtgtggctctcagatttaaggaagattacatcagtggagaaattggtaaccctaatcaagctattgcagataaaggattacaactttgcaaggatgcggcagattactgtcgcgctgttggtggccacgttgtaacagtctggttagcacatgatggatttgattataattttcagattgattatacaaatgtttgggcacaactggttaaagcatttcaagcaatggcagattatgcaccagatttaagatttagcattgagtataaaccgtttcaaccaagagcatatgcgttcattgacagtatgggcgttacaggaatgatgttaagtgaaattaatcgaaaaaatgtaggggtcactttagattattgccacatgttaatgaaacacgaaaacccagcaatggcagcagatatttttggtggtcgtaaacagctcttcggaattcatttgaatgacggatatggaatgaatgatgatggcttaatgattggaactgcgagcccatttaaaacacttgaattcttgtattatcttaaaaagcattcatatggtggaatgatttactttgacacattccctgtaattgagggagctactgatgaatgtgaacaaaatatcaagatgattaaatatcttgaatcccgaattgaccaagtaggtttaagcgaaattcaaaaagtgatcgataaaaatgatgcaattgaggcacataaattattgatgaagtttttaaataataatcctgcatgacaatttagctaataacaatatgaggagtgaacaaacatgagtatggactttaagcaaggtgccaaggatattttgaaaaatatcggtggcgcaaagaatgttggaaatatgagtcattgtgcaacgagattacgattgaacctggtggatcgttctcttgcagatgatgaaaaagttgcagcaattcctggtgttttaaatattgtatataaagccggtcaatatcagatattaattggtaccgaagtccctaaactgtatgcagaatttgaaaagcaagttaatatcgagcggggagatgcacctgcagaattaactgaagatcaggagaaagctgctaaggggagcattattagtcgaatgttttctgcaatttctgctatctttgctccattgttacctgctttggctggctctggtattttacgtggcttgttgattttggcagttcaagtgggccttatcaaaagtggaagtggtacatatacaattttatatgctgcttcaatgagtgtattttactttctaccagttttacttgcattcacttcagctaaacgttttggggcgagtccatatttatcagccttaattggatcagctttactttatccggattttattaatttgatgggtaaaactggaaatggtgcgatgactaatttctttggaattccggcagttttgatgaattataactcaactgttgtaccaattattttagctatttgggcatattcatatttgtataaatggttggatcggaaaattacggaaaatttgaaattagttctattaccattaatctcactgcttgttatgatcccacttacaattattgttattggaccacttggtgtgtatagcggtgaagcgattgctttctttgtcaattggttgattggacgtagtagtattttagccggcgtcgtagttggaggcggctggagtgttctggtaagtatgggtattcattgggccattaatccgattatgataaataatattgctaacaacggatttgattatatttgtccctggacctttgcctgcaattttgcagtaatcggtatgacagttggtgtttggctcaaggcacgcaactcaaagcttcgtagttttgctttgactggtttagtaactattgcactctcagcaattattgaaccaactttgtttggactattggtaaagaatcgtaaattatggttagcacagattattggtggcgcagtcggtggtgcttatctaggattaaccaaagttgtaacaaatgcttttgtgtttggtagtgttacaacattcccagcatttattgagaaaaatggtgctaatttcttgaatgctatgattggacttggaattgcagctgtcgttgcagcggttttagcatactttttcactaaccgtgaagaaaaattaatttaaaatgctttctattgttgaaaaatccaccattattagttattgtaaaaacaatgagggtaaaaataacaaaaataaggtggagttcaaaatgattccatatgaacgacaaaaagcaataattacattgttagcagataaggatctcgttaaaatagatgaattacacaaagacttaccaaacatttcaatgtcgactttacgacgtgatttgaaagcgcttgaatcgagcggtgatattgaatatttggtcggaggtgcaattaaagcgactgttacttcaggtgagttaccaatgtcaaaaaaatcttctttgcatgaagcagaaaagaaaatcatcgccacacgggctgccgatgaagtatgtgataatgaaagtgtttatattgattctgggtcaaataatgcattgttattgaatcaattactggatagaaatatcacgatatatacaacaaatacaattatatttaatataaactggaaatttaaggcatctgtaattttgctgggtggtcgatatgatcctgaaatatcttctttaagtggtactttaactgagaataatttgagtgatctatattttgatcgtgcttttttaggagttaatggagtagacgatgaaaaaggtattacgacaccaaatatcgctgaagcaacaaagaagcgtttgattaaatcaaatgcaaagcgtacctatttgttatgtgacagtagtaaatttcaccgtgtgtcttcagtgagagcgtttgacttaaaagatgtcatactaatttctgataagaatgatacaaagcttagcaaacacgtgccaatattacttcctgaatgatgaaaggaaagatgttgaaatgggtttattctctagaaaaatacgtacaataaatttgtttgcgccggtttctggtgatttgattgcaattgaaaaggtggatgatgaggtgttttctagcaaagctttaggagaaggctttgcaattaagccaaccaatggggacgtatattcaccaattgaaggtactgttacttcagttttccccaccaaacacgcaattagtcttaaaactaaggataaattagaggttttagtccaccttggaattgatacagttgagttaaacggtaaaggatttgaaacctttgtccaggagggtgacacagtaactgaaagcactaagctggttaacgttgatttagattatttagtcaaggaaaaaaaggctagtgatgttatggtcatttttacaaatttggatcaacgaaagttagtttataatgagggtagtgtggcgcaaggcgactctgttggtcatatagaataaccaatgattattagtgataaggaaggtcataacaacttatgttctggctttttttatcactagaaaaatgaatacgttggagatttagatgaatggtcatgaagatgtaaggctactagattctaaataactaaaggttgaaagaatcaaaatcacttcaataactagtattaaacgacttggttcaaaagtagtagtttcaatctttagctaaacaaactaaaaaaatccactactggccaaaattttggcggtagtggatttttcaggtgctgaaaaaagtggagttaactttttgaactaggtataaatgcctctctaaatttcaaaatattcgtacaaatcatcgatcgtcagcttctgtttgtcttcaccagaaacgtcgattttaatctggcccttgtccaaaacaatcaaacgattaccatattttaaagcatcttccaaatggtgggtgatcatcaaacaagttagtttatcctctttgattcgatcgtcagtagcctgcaataactcttggctagttttgggatccagagcagctgtatgttcatccagtaataaaatatcaggtcgtttaatcgtcgccatcaagaaacttaaagcctgccgttgaccaccagaaagctcgccagcgggagtgtttaagcgatggctgagatcattttccatagttccggttatttcttgaaaatgggacatttgacgttttaaaccgcggaaaaccaatccacgacgggcaccacgtttttctgctaacaaaaggttttcggatactgtcattcgcggtgctgtacctaacttaggatcttgaaaaacgcggctaaggaaacgcgttcgtttttcttctgaaaggtgggtgatgttctggtctttgaccaaaatttggccttcatcaacggctaagttgccaccaatcgtattaaacaaggtggattttccggctccgtttgatcctaggatcgtgatgaaatcaccggggtacacttttaaattaatgccacgaagaatcttttgctcatcgggggtatgacgatttacataagtggtcacgttttgcagttctaaaattggatcagtcatgatctcgcaccttcttatctgggagtggcgttttaacgctatttttaacaaatcggtctaaatgcaaagcagtgcggaaggttggtaacatcaagcacagcgctaatacaatggaagaaattaagttcaaatcgtttgtactgaacccgagttgcaacacgatcaacaagacaaaacggtataaaatgctaccgcaagtcacggcgattaaccgctgattcatggataagttaccgaaaaccacttcgccgatgatgatggaagctaacccgataacgatgattccgattcccatgttgacgtcggcatagccatcactttgagcaactaaagcaccagatagggcgatcaagccgtttgaaaccattaaacccatgatcttcatgctatcaatatgaatgccaagcgattttgccatggtttcattatcgccagttgcgatgaaagcttgacccaagttagtttggagaaacatacctaacacgatggtcacaatgatgacaatcaacaagccaagggagacactgtcgaaatatttaggcaaagactctaaaaacgaattggtgaataaactttgttttcccagcaaggagatgttggaagtgcccataatgcgcaagttaatcgaatagcaagcggtcatgaccaaaatgccggctaacaagataggaatgcgacctttggtgtacaaaagtccggttgctaaacctgccagcatcccaaccagaattgctaggagggtagctaaaataggtgacacgccgtgggtaattgcggccacacagactgcggcgcccatgggaaatgtgccttcaactgtcatgtcagggaaatcgagaattcggaaagttagaaacagtccaattcccaaaataccccagaggaaaccttgtccgattgcagatgttattaaactcatttgaataactccccttccgttttggccgttttaagtaatgagtcaggaatgtgaattcctaatttcttggcctgctttaaattaatagttaattcaccatgtttgacgtattctactggtgttttgctaattttcttacccttaagtaaacggccagccatgcggccagtcataatgcccaatttgtattggttaacgctgtaggttgccacgccaccttgtttgaccatggtatcaaccgcggggaagatcggtacgttagcgttattcgcatttttgacgagagtctgcatagcaccggcaattgtattgtcagtggggacgtagacggcatcgacattttgtaacatggtctgtgaaacttggttcaaatcattagaattagaaatcgagtaaactttgtatttaacgttttcttgccggcaaagcttagtaaacaatttgtactgtgcaaccgctgaattatcgctggaagtatagataatgccaagtgtcttaagttttggcattagttttcgaattaaaccaagttgttcttttagtggcgcctgatcggaaacaccggtaatgttggcctcaggatgatcctcgtttttgactagcccggcacctttaggatcggtgacggcccctaaaacgattggcgttttcttggtcacatcagctaaagcgagtgatgagggggttgtaatcccaatcattaaatcggcattttcgttctcgaacttctcactcatggatttcaggttactttgatttccctgagcattttgataatcgatcttgaccgttttacctttgacatagccttcatctttgagtcccgcgatgactcccttttgaatttgtgccagggctggttgattcataagttgcagaaggccaactgtggggatctttggcttggcagtttgtttggtgttactttgaaaaaatgcaaaacctagaaaaataaaaattgctgcgataaatgtgattaagcgtttcatatggttaactcctcgtattatatgttttgaaactttgcttcttactattcactactcaaaattaatgacctgcccatggaattgaattttttagaaagaaaaaagaacaatcccattgcaggattgttcttaataaatcgaaaacaaaacccacatgaatattataatccatgcgggcttttttctacgtcaaagttagccggcacagatacgatctgtatgcatccaggtcgtatcttgccaaaagacaatcacaacctaattaccggctttgccaacgattattcagttgtgtgtttgtctttgtcatatgcgtaaccaactttctttattaattgattctgagtataggtaagtttttgatgagtgtcaagacaaatttgaattttttttagggtgtgcttgggtatgaaaaaagcctctcgaactttggacagttaccagaggcttaattcatatttaagttgttgtaaaagtccaccgtcttaaacggtaagctattggatcaggatttagtcgcataaatcttgatcctttttgatcacacccatattatagaatttttgaagtgctaaaccaataaataacatattaagaaagtgttcttgaaaagagaaggataactcaattttcagatggattcaacacatatcaatcatacagattaggaaagtggtagttcctctgatttcataaattggttttaccatagttattccaaaatggacgtgaattacaaaccgtgctatactttagaaaaattataaaagtgagggatctgccattgagaaattaagttaattctgttgaacctgttagtgcacctgtcataggatggactgtgcagtttttcaggattggctaatctttctcgatgggcaggtcctttttgtatgctcatttttagtcggcctgaaaaagctagaaaaaatgaggaatttatatgtctaaaattgaaattaaaaatctaacatttggctatgatacgcaggggagtttgctgtttgatcacgtcaatttaaacctggatagtaactggaaactaggattgatagggcgcaatggccgcggtaaaacaacttttttgaatcttctccaaaataaattaaattatcaaggacaaattagtgccaatttagcctttgattatttcccccaaacaattaagaatccacagcaacttaccttcttcgtcttaaacgatttgggtgttactgagcagtggaaagtagaacgcgaactgaatttattgggaacttatcctgatattttgtggcgagcctttactacattgtccggtggtgaacaaaccaaagttctcctggctagtttatttactcaaactgtgaattttcctttgattgatgaaccgactaatcatttggatattaaagctcgtgagcaggtagctaattatttgaaacataagaaacagggtttcattgtgattagtcatgaccgcaagtttgtcgatgacacagccgaccatattctctcaatcgaaaagtccaatattttaatgtatcagggcaattttgccacttacgaagcccaaaaaaagttgagtgatacacatgaagagatggaaaatgccaaacttaagaagagcatttcccggttgaaacagacagcggctgaaaaggcggaatggtcacgttctaaagaaagcgaaaaatatggaaatccccacgttaagggaagtggatcaattggcgatacaggcgcgattggagcccgggcagcgcgtaccatgaagcgagcgttaaccttgcaaaaacacatgcaaaaagatattcaggaaaaagaaaagctgctgaaaaatattgaatatattgatccgctgtcaatgaattttgtgccaacccatcatgatcgattgttgacggttaaagatcttaccttgagttatccagattctgaaagttccttgtttgatcccatttcgtttgagattaaaaaaggcaatcgggtgggaatcgttggccccaatggtgcaggaaaatccaccttgattcgggcaattcttggtcagtttgccggcaaggtctctggtgaaatcgggcaaccacaacatttaaacgttagttacgtgcgccaaagttatgacgacaaccgaggtacgttaactgaatttgcggaaacaaatcacctagattatcaggagtttttgaataatctccataaattggggctcgaacgcaatgtgtttacaactaaaattgagcacatgagtatgggacagcaaaagaaagtggagttggcaaaatcattgtcggtgccggcggaattctatttgtgggatgaaccgttgaattatctggatatttttaatcaagaacagttagaaaccctgattaaaacggttaaaccctctatgctgatcgtggaacacgaccgggagtttatccagcatgtgacaacggatgtggtggagctgaaaacggttggataaatgagcctaattctgaaaaatggcagtatctaaatgcgagatatgataaaatgaattaaacaaatatactttgagctttataagtatatacaaatttaaggggatttttaaaaatggttcatttaatttataccgctgtattaacgattattggtattttttgtatcttcgttccgctatggctgttgatgcgcgctaacaaatcaatttcaatgaaggtgctccctacagaagacgacactaaagtgttctacacgtatgtttggttttacgaaactgggaaattagaagttctgaatggggatgcttatcaggtaggcaaagaaattcaggcaacaaatgctggcaagtatgtcatcaaagaggtcaacaaagaagtattgttcatgggaatgcaacgcaaatatgaatttgttttaggctaaaaaaaatggcgattcgcaattaagcggatcaccatttttgtttattttgatttctcttctttaagcttccaagctttgtaaagatcatagctgaacagaataaagattgcaattgtacttacggtagtaattgtaaggccaaacgagacgaaatcaatgattgacagcaataacataaatattgcaccgattaaactgataatgatttttctgttcatagttattcacgacctaagcattttgttcttcagcttgtacctttgcaacacgttcactgatcttcataaatggaaggtagagaacaacaccaagtgcgatgataacaaattgcacaacaggtgcacgccaatcaccggcagttgctagataagggccaattagtggtggagtagtccaaggtactaacacgacggttcgtcgtaccaaaccaacgagggttgcgtagtagccaataatactaccaatagttgggaacaagacgaatggaatcatcattggtaagttgaagacaattggataaccaaagatcattggttcgttaatattgaacagtccaggagctaatgataagttagcaacttgacgtgaagatttaaccttactgaaaattaaaatagcaataatcaaagaaattgtacttcctgaaccaccaatcaaagtgtagctacttacaaatgaagtagtgatgatgtttggaatatgtgcgaatgaatgtgaagttgcatatgcagtcatgttagcattcatattgattaaaactagaggatccatcaaagtaccagaaataacagtttggtgaatacctaaagtaaataggaagttggcagctgtataaattacacaaaatccaacaatgttagtattgaaaccacgtaatggttcctgaacccaagtcttaattaagttgatcaaatcggcattgaagaagcctgcaagtaacgcagcaatcaaagcgaataatgacattaagattaaagcgggtagtaaaacactaaatgatgaagaaactgcaggcggaacgttatcgcctaaatggatctgtaaactcttgtaacttgataacttaataaaaataccagttgcaagtaatccaacaataataccaccaaacataccttgtgtaccggtgtttaagtaactaagaccgccagtaacagctgacatttttgcaccagctgaggcaacagttcctagagaaaccgtctgaggcatcatgatcattaaacaagctaatgacatggcagatgcagcgattgggttagagaagcccttatttttagcaagtgcatatccaatcataggggctaccaacaaaccggcgacctgtaaggtaccgttattaatggcatttccgaaaacctggacctttgctaaagtttcaccatggaagatccatgtgaatacggtattattgagcaatacaccaagaccagcgatgataaagacgggtaaaataaccgcgaaagcatcacgtaatgatcgaaggtaaacccagttaccgactttaacggagacttcggtaaactttgcaataaaacccgagttctcaagtttttcgcttgagctttggttcttatcttcactcataagttttttcctccttttatattaaaacaatttacgctaagtcatttccgtttgaggcgatgacttttttaaaccaaccataactcttctttggaattcgtttcatgtcacgtaaatcgtgattaccacggttgacataaaccatgccgtaacgtttttccatgtttcctgatgaacttggaatatcaatcaaaccccaacccagataaccaatgacgggaacaccgtcttcaaacatggcatctttcattgcttggatatgtgcacggtgataattgattcggtaatcatcttgaatttcatgaccatcgtaagtttcacggacaccaattccgttttcaattggaaacattggaacgccataactgttgtaagtctttgtgagaatatcacggaaaccaagtgggtcaatggaccatccccattcggaaacttttaagaatggattttctttgccgccagcgtctagataataatttgggagggtattatctggaacgaccgaactgctaattgtgacgctttgataatagctgaatgcaataaagtcacttgataattgattaaatacgttctggtcagcgtcagtgaaatccatgttaatgccgtgattcttcacgaaagtgagaacttcgtttgaataacgaccgtggacaaaaacatctaacaaattacggtttaaaaattcgtcgatctgacgtgcatattgcacatcctttggtaaggatgatgcaggataaacttcgctataagctaacatgccaccaatcaagttgtcagtttgtttatgtaaataattggcaactcctgcatgggccaacatcacgtgatgtgagatttggtaaagttcatcatctgttcgctcgcctttaagatagccggcaattcggaatgtttccgaagtggagtacaagttttgctcgttaaaggtgatccaatatttgacacgatcaccaaagcaatcgaccatctttttaccataattgacaaatgaatcaaccacatgacgatccaagaagccgttatacttctcagccaaatgaagcggcatatcaaaatggtagagacaaatcattggttgaatatgccgtgccaataattcgttaatcaaattgtcgtagaacttgattccttcttcgttaaattcgccatcgccgtctggattgacacgactccaagaaatctggaatcgataacaattcattccttgattagccatcagatcgagatcttctggataattgtggtaatcatcgattgcaactttccaatctgaagagttttctgttgcaggaaatgtatcgtagacggattttccttttccgccttcgttataacctccttccgtttgcatacttgatactgaatttccccaaagaaaacctttgggcatctcttttgtcatgattcaatctccctctttcttgaatacgttttcattatatatccatattcgtctctatgtaaaggcttttatttaaaaagtatatacatctgtgaaataactagaaattataaatatacggatgtatgaaatatggggagaaaaggttagaatggggataataagaatagtggggataaatatgtataaatatcagcaaatatcagaaaaaattcgaaaaaaaatagtgaatggaaactttaaagcaggtggtctgttaccagatcaaaataagctggcaagggactttgggacgacccgaattacaattaggaaggccattcaggccctaattattgaaggaatcgtgtatacaaaacgtggtgcaggaacctttgtgcgcaaagattacatgcaaaacttagatgatatgggaaatgccattgataagcctttgggaacaactcatactcatccaaacaaaaaagtaaccagtaaggttttgtctttaaatgcgcgtttaccaactaacgaagaacaaagtagcttgatgatttcttctacagagcccgtttatgtgattgaacgagtgcgttacatcgataataaagtttacagttatgaacacacgattatgccaacagcggttgcagaaattactgaagatgtcttacatcactccatttatcaatatttaaccgatgaatgtcatctcacaattactggttctcatcgaatcgtgcgtgctgcaaaagcgacgcaaaaagatgttgaagccatgggagtcgaaaaagatgaacccgttttggtgattgaacaggtcagttatttggaagatggggaaccttttgaattctcagaatctcatttcccttatcaaaccaaccaagttacggccgacattgacttaaatgtatagcaaaaagctttaccgcagattaatacggtaaagcttttttacatacccaaatagttaatttcccgactgattagctgcgtgaaagtagaagcttaaatttgggtagacataaattgtttgtgaaaagttaaataatacgtcgttattatagtaattagattgctgcaaggtcatacaagctgttttgggttccaagcccaacaagttagcggcttcactggataaccggtcttgagataaatattgatcactattattaatccgaattccatatttttctttgatgtaatcgaaaatggaatgattaatactagacaagcttagtgaaggaacctcgcttttgacatagtacgcatattccaaactgtataactgcttatccacataacgaagacgaataacccgatacaatgctgcaccatttcgtgtgctaaattcttttgccaaagcttcatcagcatgaatctcatcaaaagttacaattttagaagtcatatttttgtgataacgtgatcgactggcacccatggttaaattaacaactgttttttctgcctggctaatatcattcacaaaataaccgctaccttggacccggcgaactaggcccttttgtgccacaatatcgatggccttccgaattgtattgcgactgacattataacgttccatcagttgatgttccgttggaagctttagtttaaataacttattttcgattgaatgaataagatcatcagcaatgtcatgatacattcagatttcctccgttccccatagtggcttgatttgtattctatttgtaactaccattcatcttccaattgtaatgaaaacggtttaatagtcaaccactttagtgtaaaaagaacatatttttttaaattagtacaagtttttaggtacaaaatggacaaaatagctgatcatcaattaatgaataaaggaccaattatattcagaaaaaaataaaaaagtttgataattcccgtgatgagggggataacgggccattgcaaatttttttcgattattaagcttgtaaaatttgtacctacgagttacaatgcagttgtaatgaaagcggtttaaaaagtaaatcgctcgagaacaaaaaataagacaaattattaggagtgagcattatggcagagaaaacaattatgttagtttgtgcagcaggtatgtcaacaagtcttttggtatcaaaaatgcaaaaggccgcagcagcagagggtgttgatgcagagatttttgcaacagcagcttcagatgcaaataacaagttggaagagaaacatccagacatcttaatgctcggaccacaagttcgttatatggaaaataatttcaagagcaaattggatattccagttgaagtaatcaatatgcaagattacgggatgatgaacggtgaaaaagtgttggcagaagcatttaagacattgggtgtgaaataagacagagtggtaaacaaagtgggtagctcacgagtactagcctagattaggaaatgattcacgtattttgtgaattgttttctaatcgtagctagacggaatgagctgctttggttagcacgtttcagccccaacaacgcaaacaattttgaaagcggaaacagaaattgcttccgtttttacataatccagaaggagaattacagaaaatggccgaagaagaaaaagaacagaacttagaagcaatcatgggattaattatgaatggtgggaatgcaaagagttctgcattcgaagcaattaatgccgcaaaaaaaggtgattttaaaaccgccgatgcaaaattaaaagagtccgatcacttcttaacagaagcacacaattcacaaactggtatgttgactgatgaagcaaacgggaaacatgctaaggtcacattattaacagttcactctcaagatcatattatgaatgccatcacattccgtgatttggctggtgaaattgttgatctttacaaacgacttgataacgtcaaagtcgaagattagaaactcgaaagggcagccaagtcattaggtggttgcccttttttaaataaaaaatgaggtgtagaaaatatgagtgaacaaaaaatgcgtatgccagaaggctttttatggggcggtgctgttgcagcccatcaattagaaggcggttggcaagaaggcggtaagggtgtcagtattgccgatgtcatgacggctggagataaagatcatccccgtcgcgtaactgatggtgttaaaaaaggtgaagtttaccctaatcattggggaattgatttttaccatcgttatccagaagacatcaagctatttgctgaaatgggattcaaatgtttccggacatcaattgcttggacacgaatcttccctaacggcgatgaaacagagcctaacgaagagggactccaattttatgatgacttatttgatgagttattaaagtacaacattcaacctgttattactttgtctcattttgaaatgccttatcatttggttaaagagtacggcggctggtcaaatcgaaagttgattgggttcttcttaaattacgcggaagcagttttcaaacgttataagaataaagttaagtattggatgactttcaacgaaattaacaaccaaactacttgggatgatccacacccaatgctgcaaaactccgggttacaacttggtaaagatgataactgggaagaatcaatgtaccaggccgctcattatgaaatggtagctagtgccaaggctgtaaagttaggacatcaaattaatcctgatttccagattggtgacatgattgcgatgtgtcccatttatcctttgacggctgatcctaaagatatcatgatggcagaacgggcaatgcaaacgcgttactactatggcgatgtgcaggctaacggtttctatcctaactgggtacctaagtattgggctcgcaaaggcttcaagattgatcgtacggaacaggatgctaaggatttgcgtgaaggcactgctgattacgttggcttcagttactacatgttatttgtaacgaagtacaaggctgacaatccggattatgtttatacagaatctaaggatcaagttgataatccttatactgaaaaatcagattggggctggcaaattgatcctgttggtttgcggtattctatgaactggatgcaggatcgttggcataaaccaatgtttatcgttgaaaatggttttggcgcttatgacaagaaagaagctgatggtagtgttcacgatgattaccggatcagctacttccatgaccacattgaagcaatggaaaaagccgttgttgaagatggcgttgatctgattggttacacaccgtggggctgcattgatttgatttcagccagcactggtgaaatgaagaaacgctatggctttatttacgtagatcaagatgacgaaggtaatggttctttggcccgttctaagaaagattcctttgattggtttaagaaagtaattgcttcgaatggtgaagatatttccgaaaaataaaacgctataaaatgagtttaatttaaataaattagaaaaacagtcagtaaaagtttctgtggctgtttttttagtctgaaacatgttccacaaccgaagacaaagtgctattctatagaggtaatcaggggaagttgaagggatgacgattcgtcagttagccaaaaaaagccatgtgtcaccgacaacgattttgcgttttttgcacaaaatggattttgacggctactcagagtttaagtatgcgctcaaacggcagcaaaaaatgcaaactgagcaacccaaacagcaacgaaatgtcccaatgagtcaattttttgatcagttaaacgacgcccattttctggataagattcaacaagcggctaattatataattgaggcggataccagtttgttgtttggtctgggaaccagtggcagcttggcacagtatggcgcccggttattggctaactatgggatttacaccttaagtattacggatccgtttcagccaaagccattagcacgtcgtgatttttcagataccttgttactattgttatccgtttcaggtgaaactgctcaggtcctgcaacaggctaaattctatcaagaaaatggcgcaaaaacgatggccattacggccaatcgctattcaaccttagctcaattggtagatttcaatatttcctataacgtgccagaagtcttgatggcggatcttaatttaacatctcaaattccagtggtcttcttgcttgaacaaatcggaatcaaggcccataaagatttattaaaagtagcacaaattccaaaagattccattttttaataaaaattcgaattttgaggatgactcaaatattggaccagaccaattttgagatagtcaatagactagtgatgttctctatgaactaaaagcataccaattgataccatgaaacatgttacgcttagtgacatgttttttttaacaaaaaattaaactttttgagtgaaataggtaggcacaaatctaaaaatgtggtatattgtaaacgatgaaaccgcatacaatgggtttcaaataaactttgtcacttgcaaaattataattataatttgacagattttgctattcatataacgttgcaagtgataaattgggagggttttatatgagtgagaagaaggaaaacggcttcgtgcaaaatacacttattcccttagctgggaagatggctgcttctcgtcatttggttgctcttcgtgatggatttgcactggtaatgccactaatcattattggttctgtcttcatgatcgtcagtcagtttccaattccggcctacatcaattggatgagttcggtatttggtcctaactgggcaacagttgttggttgggcgacaaacgcaacattcaatattatcggaatggttgcctgcattggtatttcatatcaattagctaagtcgtatgacggtgttgatgcactgtcagcaagtattatttcgttaggtgctttcttactaacaattcctctaactacggataaggccggtaacacattcgtgcctttgaccatgttaggttcaatgggattgtttgaagcactattagttggattattcattactgatttttatgtatggatgattcataagaactggcagttccatatgccagatacagttccacccgcagttgggaatgcgttctctgcattgattcctggcttcgtcattattgctttagtttggttacttcgtatcggaattggattcacattcttcaagacaattccaaatatcattacagttatcttagctaaacctttgacagccgttggtggtactatctggggagctcttgttgctgaattcttcgtttcattcctttggctatttggtattcatggtgctaacgttgttggtggtatcatggcaccaatctggttaggccaaatgggacaaaacgctgctgctgttaaagcaaacaaacctattccaaacgttgttagtcaacaattcgttgataacttcgtccatgccggtggttctggtgaaactatttccttagctttgatgatgttattctttgctaaatcagctaacttgaaggctattggccgtttagctggtgcacctgcaatcttcaacattaacgaacctattatgtttggtttaccaattgttttgaaccctgttatggcaattccatttatcgttgtcccattggtaacagttattattacttatgtttcaatgaagactggtattgttgcacggacaatgggtattgcggttccttggacaacgccgccaattatttcaggttggttggcaacaggtcacatttctggtgcggttcttcagttagttaacttcgtggttggtggtgccatttggtatccattcttcaagattgctgaccgtcaagcattgaaacaagaaaaagaaattgctgacaaagaagctgcagaagctgctgcaaaaaactaaacattagtttttaaacctaataaaatctgtcgaatcttcttttcggcagattttttggtaaaaaggacagagtgtttcaaagagcgattagcttctgagtacagcctagatagtcgaatgattcggtttaggaatcgtttgactatcgtagctggacggaggaaggtgctcttttaaacacgttttaactgatcaaaaagtgcaatctgacccgaatattcagctgacttcttccgtgaaaacccgagccggaacgtagtgggcacaactttaagccaacaagttgtcttaaagcttgaccttattgtaagtgctaaagcactaacaataatttcactactgggctcatttcactccaaaagtcatctaaatattctaaatagctttaattaaaaaacgcaacactttaatttaccaaaacacgtataattgacagtaagagagaaattcattattaagaggagcgagaatcatgagtaaacataaaaagaatcggccagatagcgccgttgagcgagctgctcaagctaacgtagacaagatcatggagaaaacacgatctcaacaaggcacaattgatcaactacctaagtgggctcaaaatatggcctataatcggtttggcttaagtgaagtgatttcttttattcccctaatcattgccgttttgacaacgccattattgggaaatcgtgtttccatgggcgggggactcatgattaacaaaaatgccctattcattgtaccttttgttagtttattaatttctgggggaagttacctcagtattaaaattcgtcgaaaatcggaacgagttccagacattgaacatttagcttggaatgaggtttttgcatttctcgccaatgccttggtggttctcatttgttcattagtattaatttatcagctatatagagcttttacagcttaaaatttttgagggggaattattttggcacgattaggaatttctttatatccggaacactcaacatttgaaaaggataaagcctatttagacttggctcacaagtatggatacacacgcgtttttacttcattacttcaaattaatggggatcaagacgcggttgtcgcaaacttcaaaaaaattgtgcagtatgccaattcacttgatttcaaagtcatggttgatatgaatccttctttatttaaacaactcggagtgacctatgatgatctatcattttttgatgatcttggtgcatggggcttgcgattggacgaaggatttacaggtatggaagaatcacggatgacccgtaatccttatggcatcaaaattgaggttaacatgagtaatggtacccgttacttggaaaacattctcagttttgcgcctgacaaacaaaacttattgggttgtcataacttctatccacaagaatatacaggattaggcgaagctttcttcacgaagtgttccgaattattccgcaagcacaacattaacaccgctgcgtttgtcagttcgaaggatgcaacttttggcccttggcctgtacaagatgggttaccaacgattgaagatgatcgtcacttaccaattgaaacccaagttcaacatctattgctgactggtttaattgatgatgtgttgattggcaatgcctacgcctctgaagctgaattaaaggcagcctcagaagcccttctttggtcgctatcctgtgttacatgctgacttcgtggatgacctgacagcgaacgaaaagctggttgcattgggtaaaccacatttgtatcggggtgatgcttctgattatctgttacgggacacaatgccacgtgtttggtataaagataaagaaattcctgcgcatcatgaaaaagaagcctttaaacgtggtgatatcatcgttgtgaatgacagctatagtcgttacaagggtgagcttcagattgcattgaaggatttcccaaatgacggacgccgaaatgttgtggggcatttgtctacagatgacctgttccttttagactacatcaagccttggagcacatttgaattaaaataggtcaattaataaataggagcgtggttgtctaaaaagataactgcgttttttattttcaagcactgcaaacgtttacaaaaaaacgatttggtgtattatgaaggcgaaatgaaagcattattgcttcatcgaatactattgggggcgtgtattatgagtcaaagtttgttgggaattgttgttttgttaattagcctagggattgtctatggtggatttcgctatgttcgtagtggcaaaagagcctatgccagtgctggagtgaaagttgattttaataaaacaccagctgcatatggatttgcgccgggagttattggcacaattattatgttggtcggtgtttgtggaattgtttggagtctgattcttttataaaagttttggaactgatgcaggtgtctgaacagatgcctgtttttttgtgcttttgtattttggaaaacatttttgatattagaattaatgatgataattagaaaaatgaaccctatgtttctggcatttttggaaacataaggtttattttagttatgattgttatttttgtaaaatggtgctatgatatcggtgtgatatcaagtaaccggtttcaagtgtaaaattatggggaggttttattatgtataagattccagcttcggcatttgaatctattaacgattaagggaatgataaagaaaaatcagttttacatgtctttacaccaatgcgaatttcaattggtggtagagtttttccacatcatccgaaaaaagatcatggcgtcctgagaaagttttccaaaaaggatgcggttgtgaacaatccagccttaattgaatttacagatgatgaaattaaaatccatgatgaacagggaaaggttattcgaacggaaaaaattgggacgtttgattttgttcaatttggggctctccgtacatttatggtgttccctgcttatacctttgctatgactatggttgttggtgcgcatgggcaacattattacgttgtgaatccgaatttcacgccatttcagctgttaacaccaattttaaaacagcagtcagtcgcaattgaagatccctttaaaattgcggggttgccaagtaatgaacaacgtgaggattactttggaaatgcctatgaacaaaaaattaaagggacaaattatccactgtcattagagtggtggccgttctaacctgtgatttgccaaaaacggtaacaaaaaatttttactcagaaaacaatttagtcaatttaaaagaaggttttattatgtataagattccagcttcagcatttaaattaacgactagtttttcggcagcagaggatcagaatatgaaaaaatgttttacatcaatgcgcatctcagtcgatggtcagagctatccgcactttccaaacaaagaaaatggtgaatcggtgaaacttgctagaaaagttttcggcttaccagcaatgtcaacaattgaattcacacaagatgaaatgaaagtacatgatcaaaaggatcaaattgttgaaagtgaaaaaattgcaacctttcagcgagttcaatttggagttattcgaaaaatgggatttggtggccgtgtaccgttgctaacttgcgcgatgaccatggcaattgtgactgaacaacaaaattattatgtcattaactctagttttgaaccttttaacgcattagttgcgttatttaaagcacagggtgtttcagttgaagatccgtttgatatcacttcactaccaagtaatgaaaaacgggatgtgtattttaataaggactacgaagataagattaagggaaccaattatccgatttcttacggatcaaattatgcgatcaaaggattttagaataaaagtgacttattaaatttaaggaagcggttgtgatgccatcatttgtaggaattatcattaatttaattagtataggcatcatttggataggaatccgttatgtgcgtattaacaaggaaagatttgttaaagccggtgtaaaagttgattttaaaaaaacgccagccacgtatggttttgcaccggaaattacgggagccatcattattatcgtcggcattgccggactggtctggggtgcaatgttagtttgaagatgggggagtagttatgagtaatggtttatcaatgaagtacgtgcgtattttaaggcagtggtacatttggcaacttgggattgcgtttattgcgttttgtatgagctttttctgggagccatttggttcaacacgtttgattgaagttatcgctggcgccttggtggtgatttttgggataggcatcccattcgaaaagcccttaaaagcagaacagaaatttaaaagagtccttagaaagtgcaattattgttttcaatcagtggctcagatcttactgttgccacttggattagctgcagttattctgatgtttcacaaggttttattgttgaattacccaatattagcgatccttaccatgctatacgttctaattatgtatgtacccactgcatactatgtactggtgaacttcaagtcttatattggcagaattattttaattacggttgtcggttttgaaacaattggttctgggtcgatattatcactgatgtataccctattggctgtttttgatccattatcaatggctttttaaattagggcctagtacttttggaatggaaatactttccaacaccaaaaattctagacccaaataaatttacctacgggttatttatcaattaactttgatagatagtaaccaattacaaatcccaaagtattagcaagcacgtcatttatatccacccaacgatgcgttattgccaaattatctgttataaattggacgaattcgatagcgaatccaataaggatcccagttgtaattacatgagaaattttgaatttaggagagaataagatataggtaaatattcctaaaggacaggtcataatgatatttagccagaatcctaattgatctaattcttgaaagggaatgtaagcaactggtgccttaccaatcatcataaagctaacagtttgatttgactgaggtaatctaaaaggtaaggttgggctaaaacataagaaacaaattaataaagctgaaattcctaataatatccagacacatacttttgaaatatggttaataattcatcatctactttcattattaattgaattaaaaatattgcgataatttataaattcttccttaaatagatatccggtttgaaatcaagtgatttttaactgatttttcaaatgttaattgtcactggcagatcaaatggataattgacaacagaaaatattctaccaatttgtgaaagctgggtcaagaactttcttccaaactaactaaaaaagttctgggcatccctcatccaaccacctttagccctggcaagtgacgtaaatccgatattcaatcggtaatcagtccagtagtgaattctcttcggacgaaagctttttggccggcgaaggatttcaagattaacatcagtgctgcgagtggagagactaattttgccagaatactcatcaatatcaataatgagcgcggaaactgtttgtccaacccgaaagatcttatagaggtcatccacgaatcctgtttgacactcagagatgtgaatcagcccctgcatatgttcaccaatatccaggaatacgccatagggttgaataccagtgacggttccatggaccttcatgcctatcttaaaactcataataatcatcctatctgtaatctgttaataattgtagcgtggatcccttgatttaacaacaaaacttattttttgttaaaggacaggtaataactcgccaacttctcagggaatttggtaaaatcaattataaattttcgaaaggaatgattacttgagcacgctcattgattttatcttacacatcgacgatcacctaataaatatcgtgaatacatttgggaactccacctacctcattctctttggagtgatctttattgaaacaggcgcagtcatcttcccatttctgcctggtgactcactgctatttgctgcggcggcattatcagccaacgtaaactacggtttaagcatcggcttgtttgtaatcatctttttggccgcttcaattggcggcgattcactcaacttcttctttggaaacaaatttggagaaattattccccgaaatcgaatcctgggaaaatttattaaggaaaaggatttaaccaaggcccgggagttctttaacaaatatggggcaatggccatcttctttggccgattcattccaatcatcagaacgttaatccccttcgttgccgctacgagtgattttccttataaacgattcattaagtataatctgattgcatgtatctcatgggtcgccatctgttgtggtgccggctattacttcggtaacatccccgttgttaaagaaaacttctcgatggtcattattggaatcgtcgcgatctcgctcattccggcagtcgttggctatgttaaaacaaaatttgcctcttccaagtagacagtaatttactttcagaataactcttgatataattaaaactgttgtggtgagttggcagagtggtaatgcaccggactcgaaatccggcgaaccggctaataccggcgcgcaggttcaaatcctgtactcaccttatatgacagtaagcatctcagcgtaccaatgctgagatgcttttttgtttaactaagtacgaattcaaatgtaacaaaaaagctcattgccactggataaccagcagtaatgaacttggtttaatattttagcaaagtaaagaaatcatagtctttgactttttcacggcctttaagatctgacaactcaatcaaaaatgcggtgccgacaacaattccgcccaacttctctactagacgaatagttgcatcaattgtcccaccagtggccaataagtcatctgttactaagacccgctgacccggcttaacagcgttggttcgtaagtacagtgatgatttaccatactccaagccataactttcctcaatcgtttcaccaggcagtttgtttttcttacgagctggtgagaaaccaacccccaacttgtaggcgactggacagccaacaatgaaccctctggcctctggacccacaatcatctgaacgttccgttccttggcaaaatcaactatcttgtcggttgctgcccgatagacttcaccgttttcaagtaaaggtgaaatgtctctaaataggattccgggttccggaaagtccggatatgatgcaatatattttgaaaaatcgattggcatattctttcttcctttcatcaaacacccaaacagtccttgacgaagctgactaattcatgagtatttgaaaccaacaatttcttttcagctgcaagctgttcaactcgaagatggtaacttggagctgtttttaaatcacgggcagtataattcggattcaaattaatcacccgatcctgaatcgtaatgaaatccaactccaaaaagacttgaaccataaaaataattgtccgtgcagaaatgtgtaagtgctctgaaatttgttttaactgcgtcgcaatattaacgtttgaatgttctttaacgaacctaaacagtttagcataagaattccgatctggcatccctattttggagataagttgttttttgtaaagatataggaccgtggtttgtggttggactttggctaagagctgaaccaaatcgtcaagcacgtccggacaatcaacaatatacaagcgattgccattagccgatgcctcggtgacttggtcatacatcacaacttgcgattggtcacccacatatccttgcagctgttttaagactttttcgtggaagaaaacgtaagtgccgactgtcgcaaacatctttcggtgcagctcgtgggtccgctcatcgatcaccggcggtaatgtctgcttcagatcatcgaccattaattggagcgtcgttcgattattccaagtgttttccccaatctcgccaaccacttgaacggctgcttgagaattttgaagctcaacggcagcacttcctcgaccaaaggcaatcgcagtgagccgattattgccttgaaccagtgaaaacttcaggtgatcactggtcttacccattgcctttacgttggcgagctgatcaaattggacttgaaaaatgggcttagggttgtcctggccaaacggtgccaaagttttgatttggtcacataacactgctgtaacctgagagaccggaataacgccggcaatggccaacttgggcttaacagataaatccaattgctgctcttccgcagctttttccaactggtccttcaaaacaggcactttgtccttcttgatggtcaatccaactgcagaatggtggccgccaaagccaatcgtttgatcgcgaatggggtcaattgctttaaataaatcaaaattgtcgacactacggccggatcccttaacctcttcgctaccatcggtgtcggtcatgacgattgtcgggcgctgatatttgtcaaccagtcgacttgcaacgattccgagaaccccctggtgccagttatggccgacgacaaccagcgtgtgccgttgagaaatgtcgccactatcttcaacggactgaaccgcttcagtgaagaactggtcgacaagtgacttgcgtaagtcgttttgctgattggcaaatttggctaattcacctgcgcgatcctcgtcaaatgtcgataataattcgaccccgactgtggcatctttgatccgaccaagcgaattcaaacggggagcaatcccaaagccaatatcttcttcgctaaatctccccaaatcaatgccggcttccttaatcaaagcaagcagccccggacgttgactatttgaaatcgcctgaacaccgaatttaacaattgcgcgattctcatcacgtaacgatacgacatcggcaaccgttccgatcgctgtaatatcaatcagatcagacggtacttcgtccatcaacgcttgagcaactttaaaagccacgccagcgccacaaagatcgccaaatgggtaagcatccccattttcattttttacccgcggatgaataatcgcatacgcatcaggcaacttttcaggaagcgagtgatgatcggttaccaccacatcgcaatgcaactcatttgcagctgcaatcgcttgattcccggcaaccccgttatcaacagtgacaatcagtgatgtacccttttgaataatcttttgaaaagcttcgacgttcgggccgtaaccttcagtaaatcggttgggaatataataatcaacgtcagcacccagatcactcaatgtctcgtacataacggttgtgctggtaatcccatctgcgtcataatcgccatagacagtaatatgctccccattttcgacggcttgttgaattcgttcaattcccttatgcatatcatgcatcaaaaacgggtcatgaaaggcactgacagaaggattcaagaaatcctcgacaacatcagcactggtaatgccacgctgaattaacattttagcgataaatgggtcaatatttgcatccttggccaacttgtcaactactgacgaatcagctggttgatcaagctgccacttatacttggaatcaatcattaaaacactctaccttacttttgagatgataatttctcggttaatttggcaatctcatcctgcaaatcactgatttgttgatctcgactaccaatctcctgtttacccgtcgaatttttcaaacgagtttctaattctttgagattgttattgagttcgccaatctcggcgtttaaatcgtcttgtcgtttttggctttcagatgccaattgcttatattgacgattctttttgacattctgagtcgacgagaacagaaaaataatcagggcaccaattaagagacaaatcaaaatcaaaagtaccagtggcacctgaaatgatgcgaagccaaagttaacctcaacagattcaaaattcatcaatgcaaaaattgcaatgatgataatcaatataatgctgataattgtgctaatttgctttttcaatcttatccccccagaaatgattcgctaatgcttctcaaacgggatctcaatgacatcaaaatccttcacaactttggtattgggaaataccgtttgtgcctgtttttcaagttcatgggccattttaccggtataacgggcagaaatgtgattcaacagcagcatctttgcgccagcttgtttggcgatttgagcagcctgcatattggttgaatgataataattcttggcaagtttgttttcacccttgccaaaggtactctcatgaaccaaggcatcggcatgctctgccagtttgacggcgttgtcagtttttcgggtatccccgataatcgtgacaattcgcccgggttgggcacgaccgatcatttctttaccatcaatcacccgaccatccgtcagcttaacagtttgtcccattttcaacttgccatataccggcccggatggaatatgcaactgagtcaacttctcgaccatcaattcgcctggatgatcatgttcaacaacccgatagccaaagctggtaatccgatggtccagaggcgcggcataaacagtaaacttcttaccttcaaaaattttgccatcggtgtccttgggtaattcatggaaattaattttatacgagagccgactttcagaaatcttcaaactcacattgacatattctttaatcccttttggcccatatatgtccaatggcgtgttgccgccttgaaacgagcgactgcttaacaaccccggcaggccaaaaatatgatcgccgtgcagatggctgataaaaattttttcaatcttgcgggggcgaattgttgaacgaagaatctggtgttgggtgccttcgccgacatcaaataaccacaccgagttgatttcgtcaagtaaccgtaacgccaagcttgacacgttgcgaaatttgcctggagaccctgccccagtgcctaaaaattcaatctgcattattatcgtttccttatttttaaaatcgagttagagtgattggcacctgccaaccgcttaaaatcacttttcaattgtatcataaatccgttaaaataatcattagaagggaatggcagccatgaatttagatgagtttttccgcgccagcagtacactaaacccaaagttgaccctattaatttcagaaggtcagcactttttgccggttaatcagctgttaattgataaaaattcgttattgttgggcaaatcgagcccatctcagggtggatttgctacaataacgttggatcaattcatgaccagaaccaaacggctctccctcaagacagatttaagaactttaaacgaccgccaattgatatttgggtttagaattgtcaataaatcaattgttttttactaggagataaaaatatgaaagcaaaaggatacttaatcatcatgtttgccatcctgtcggttggattagcagcctgcggtggtaataaaagcaatcaagcaactgagaaaaagtcattgagtgctgatatgtcaaacgagccttccagctcatcaaccagttcaagttccagccaatcgtggagtgattatcaatacaaagttcccaaatcagtccaaaagaatgctcactatgtcaaaaatggcgacttgagcacgaaacatcaatttacttttgaccgttttgggactcgacagcaattagccgacgtgaccaccaaaccggttgatatcaaagctgacaaattaacttataaagtcaaccaggtaagagtcatcaagaacaccgccaagacgccgcaagctaaagaggccgccgaacaggtgctcaatctacgcagcattccagacacttactacaccttcgttctcaattacacagtgacgaatcatcacaactttgaaattgcactaaacggtgtcaattatgttaaaaccaatcaagggcaaatgttgaccacagctaatcaattaaccgactcgtctgccggcaataaaattggtgctaatcgagccgtcagctttgcgatgaccggctaccttcacaattatgcgactcagccggcaaccaaactcaccattcagtttggtgccatctacaccaccactcaaaagaaagttgccccctcaccggattcaacactcaccattaatttgaaataagccaaaaaagtttgaaagccttcaatccagctgcttgcatggaatgaaggccttcaaacttttattttttactataaaaatcgctaatcgacgtcgcaatgagatgtgtataataaatattcccttttggattgggatgaacgttgtcgttccagaaccaatcccgccgattcaaactatagctgtgccagtcaatgatatgcatattcttatggcgtttagcagcagctcgaatcgtgtgattaacttcggtttcccaatttctggttggcacgtgagtcgttacccagaagatttgatgcttgggtccaattgacttgataaccgaattaatctgggcggaagtcattggtgagttggtccccaagttaattaaaacgttaggtgccagctcgtttttattcttcatttgggtcaaaacctgcccagcctgccaaatttgacgaccaacggcagcggaaacataggcattttgaaagacattttgaagatcgtgactgttatcagctaaaatcgagtccccaatggcggttaacggttgttgataaaccgtcagatactgacgtttgttcaggccatagtgtttggcgattttatactgcttaaccgtcaatttcttcttcagcagtttcttcatccgcttttgattggcagtgagcttggaagccttcttttgtttagctaacgctgccttgttatttgcattagcggtcttttcgttcttggagatgttttcttccagtacattcttggcatctttggtaggtgaaattgcacttccatatgccgaaatcccaatcagcaaaattgctggtatcagccacaatcgtttccagccgtattccgaattcggttgaacaaactcgtaaattgaccgaccgaggttcctgtagcggtaatgtcttaacggtgcttcaatatatcgataggacagctcactaataatcataatcaaagcaatttcaatgcttgcattcatcagtggatgggcagcaatattttgaactttgatctcataaaaaatcatcactggaaattgataaagataaattccgtagcttctggtccccatccatctaaacaccggattggtcagccagcggttcacgtccgctcccggatgggcacaggctgcaatcaaggttgtcgaagcgattgccataatgaacattccgccacgatacgtaaacgtgttttgaccagagagttcaaaatacaggtaagcaatgattgcgattgacaccagcccaataatattgagggtccaacgcgatcgcgtcgtcacatttttcttcagatgagtagatggccaaataacagcaagtaaagcaccaaaaacgattgaaaacattcgcgtgtcggtgccgtagtaaactcgattcaacgtatccggaccagtgtacaacagtcccatcaagacaccggaaccaattgccaacacaagaagaatattggcaattgtccgccgtttgcgaataatcaagaccatcgcggttagaattaacggccatattaagtaatactggccttcaattgataaggaccacaaatgcgtaaacggtgattcaccgttaaaccggtcaaaataactctggccatggccgacctcccaccaattgtaaacgtacagcatattggtagtaatgattgaccgtaaattggttaatagtgagcgttgaaacagcgttatgtatgtgccggttcccaccagcataaacaccagagcaggatacagccgtttcagacgacgcgcgtagaatgcccaaaaatcaatccggccgttttgctcccactcttgtaacaaaagatcagtaattaaataccctgaaacgacaaaaaaggtcggtacacccaagtaccccccttgcagcttgtacggcagcaaatggtaaatgatgacaccaacaaccgccagtgccctgatcccgtcaaaaccggatatataacggctgtttttaagccgtttgccttgtttttttgtttgaacctgttgcatcgaaatattccctgccctatatgaatttgtatttccccaaataactactcaacgtatgtgaatgagaagtccaaaacagtaaccgtgtcaccatctttggcccctgccttccgcaaggcatcatcaattcccattccatgcatttgtcgcgcaaatcgtaacatactttgatcatgttcggtatcagtcatcttgaataatttctcgattttatcaccggagataacccatgactcatattctttatcgtattcaatatggaaatcgctggtctcagccggttggtaagcgtactccttggtcgtttccgctggctgctccatgtctgaaagcttggttgtatcaagcaagtcagccgttcgtcgaaccagttcggttaatcccgtatgggtcactgaagaaatcggaaagatctctcgcgtcttatctgcatctgaatgctcggccaactgctgcttgaagatttgaagattatcggcagaatcgggtaagtccatcttcgtagcgacaataatttgtggtcgtttcaaaatgcgctcgtcatattgttccagttctttattaattgccaaataatcctcaaatgggtcacggccctcaagacctgacatatctaccaaatgaagaatgactctggttcgctcgacatgacgtaggaattggaatccaagtccaacaccattcgaagcaccctcaaccaacccgggtaaatcggcaactgcaaaatcacggccgtcatctaatctcaccatgccaaggttaggaaccaaggttgtaaaatgatacccggcaatctttggcttggcgctagtgataaccgataacagcgtcgatttaccggcggacggaaatccaaccaggccgacatctgcgagcacctttaattcgaggctcaaagacacttcctgacccggttcaccgttttcagcaatttccggggctggattagtcgggctggcaaaatgaatgtttccacgcccgccgcggccggctttggcaaccactaattcttgatccggcttaaccagatcgccaatgacttcgcccgtaacggtattggtaaccgtcgttccctcgggaacaggaatgaccaaatcgtcggcacttcggccggtcattgatttgttggcgccgttcccgccattcttggctttaaactttcggtggtatcgaaagtccatcaaggtgttcataccagaatccaccttaaagatgacattgccaccgcgaccaccgtcacctccggcagggccgccatttggaacatatttttcccgtcggaaggcaaccatgccatttccgccgtttccagcttttacattaatctttacttgatcaacaaacatcttatcaccatttaattaattctaattaatcccaagtcgttagttacgtgttcaatactctagcagtataccgagtttcctacatcaggtcaaaataatcttgagaagaaagccctttcgaatcattttaatgcgtcaattttttatcttgataattggtcacttttcgttcttcatcaatcttactcaatgagaacttgattgtttgcgccacagtctctgaaatccctaattgacgcaattcctcaattggggcatttgaaattttcctcagcgatccgaatttccggagaagtttgttccgtgtcttgggaccaacaccggcaatcgaatccaacctggaactcaatgagttctttgtatgaactttatgatgataggtaatcgcaaatcgatggacctcatcttgaattcgctgcagcagataaaagccctgactcttgggatccaactgcagtggcgtgtcattatcaccaaaaagcaaatcggcagtttggtgatgcgtattcttaaccatcccaccaaccggaatattcaatccaagttcattgaccaggacatccttgacggcgttcatctggatgaccccgccatccattaaaattaagtccggcatctcagcgtgctctttgagcagtcgggtataccgccggcggatgacttctttggtgctggcggcttcatctgcgtgatcgacggtctttaatttgtactttcggtataaattcttattgggctgaccatcaacaaagaccaccattgcagagaccagatcggctccttgaatatgagaatggtcaaatgcttcaattttgtgccccggcgcaattcccattgcatcagtgagttctttcatggccccggtcgtcttgctctcatcaagctctaacaggcggaatttctcctctaggaccatctgggcattcttaccagccatctccaatagatcgcgtttctgccctctctggggggttctaacgggaacatcttcaaccacgtgactaatcacatctgttggcagtgatttgggcaccagaatctccttaggcagaatctgatttttctgcttataaaattgtgagataaaactgaccatttcttcttcaggatcatcaatgatcggaaagagacgtttctcacgtttcatcaatcgtgattgacggatgaagaaaacctgaatcgagagccagcctttatccatatagtaattaaaaatatcgcgaggcgtattatcggtcgaaataattttctgtttctcaacggtaatttcaatgtacttgatcagatctcgaatttctgcggcccgttcatactccatcttggcagctgctttttccattctagtcgtcagcatctgcttggcgtgagacacattgccattcagaaacgacttaatccgtttaatctgcttggcgtacgtttcttccggaaccactttaaagcaagccccgaggcactgtcccatatgataatacaggcagggccgattctgaaatccgttgcagcggcgcaatggatagaccttctgcagaaagttaaccgtctcttcagcagcatagacgtttggataagggccaaaataaaaaccgccatctttgagtaacgtattgacgattttaatctgagggtcccgttcattcgtaatcttaatgtaggggtacccaccgtttccctgttttaatttgatgttgaagtatggccgatgcttttgaatcaaggtgatttcaagcagaaaagcttctttgtcactcgaaaccacaatgtattcgaagtcggcaatttcggagaccaaccgggcagttttgccttcatggctgctcttaaaataagaacgaacccggttctttaagtttttggcttttccaacataaataatcttgccgttaatgtccttcatcaggtaacagccaggcatgtcaggcagtaaagccaatttatgttcgatatattcactcgccaaaaaactcactcctttcataatattcatctaaaaattatacatcgaatatatgtttggttcaaccgatgtgtcccagagagtgtctgacttagagggatcaaaccattctttcatccaaccaacattcgcgggattttcataaccatctggtatcaatagattttacaagattcgacaatgaatttcatctatctgcctctttttactttgaaccagggattggacctgatgtttctgccagggcaatttaaacaagcaaaaagatcggcgacaatgaaccacatctaggttcatctcaccgatctttctaatagttaaaagcctgcgtcatacattttgaataatctttccgataaagtctttggcccgctcattttgcggattgtcaaacaactcctcgggtttatttcgttccaaaatgtagccgtcggccataaaccaaacctcgtcggcaacctctttggcaaatcccatttcgtgggtcacaacaaccatcgtcatcccttctttcgccaactcgttcatgacttcaagaacttcaccgaccatttcgggatccaaggcactggttggttcatcaaacaacatcacttccggattcatcgccaatgcccgggcaattgccacccgttgttgctgaccgcctgaaagactgcttggataggcgtcggccttttcagctaatccgacccgatccaagaggtgcatggcgatcttttgggcttcatcatccttcatgtgtttaacccgaattggtgccaacttcagattctcaatcaccgtcatattggggaataaattgaagctttgaaataccattcccattcgctcacgcaagttgatcaactgtttttcatcaacatgagtcagatcggttccttcaaacttcacttcaccggaggtcggtttttccaataaattcaggcaacgtaaaaaggtacttttacccgcaccggatggaccgattacgcagataacttcgccggatttgacggtcccattgatgtctttaagaatttcattgtcaccaaattttttatttaaatgatttacttcaagaattttcttatcctgcatgtttcatcttcccttcaaaatggttcaagactctggtcaatgcaaacgtcatgatgaagtacagcagcatggcgacgaaaatcggcatgacaccacgatacgtatccgcacgaacgatgtttaattgatagatcaaatcggtcaccccaataatcgaaacaatggagctttccttgatcagggaaataaattcattccccaaagccggccaaatgttcttaaaggcttgcggtaaaataacaaaacgcatcaggtcaccctttgacaagcccaagctggcagcggcctcggtctggcccttggcaaccgaattgatcccgccacggataatttcagcaacgtaagcgccactattcagtgatacggcaatcatccctgaaatcaaagctggaatattgacgacaaccccaattccaaagtaaacgaataaaacttgaaccattaatggcgtgcctcgaataaattcggtgtaactaattgccagaccccgaagccatttctgtttggaaaaacgcatcagtgccaggataacgccaatcaggaccccaaagaacgtcgaaacaatcgagatcaggattgtgtactcaacccctttggcaaaatacttccaataatggaacatggaggtatttactgtattaaccttcatatacttgccggcgtcagccaggtactgttcggtgaggttctgttttttaatctggtcaatactcttattgacggcggcaactaaactcccggacccttttttaaaggcaatcgcagcgccaatttcatttttgttcaaatgatacccggatgaaatcatttttaggctgggatcatttttcacataagcttcggcactgggcttttcaattcccaaagcatcaatcttatgagttttgagggccagtaccaagtcggttgacttgtccatccctttaacggtggaattgggaatttttttcttggccagaccatactgcaaagtaccggtctgggcaccaattgttgcacccctcaaatttttggcgctcttgtatttgttgacatcgcttgaattaatcaagaaactttggccgcctgaataatagatctttgaaaaatcaacactttgacgacgagctgcagttgggttaatacccccaattgccatatctgccttgccggtttgaatcgccaccaacaatgaatcgaagttcatgctcttaatcaccagtttgacgtggagatctttggccacctttttggcaacgtcgatatccatcccaacgattttatccttgccatttttattcacctgaaattcgtatggtggataatcgggactggtaaccataatcagttccccacgctgcttaactcgttgcagtgacgtgtccgcagcggaggcaggatttgaaaatactgtggttaaagtaaatacagcggcaatcataatcaatgtctgaataattgctttaagactcttcttcatcaagtttccctcttccaaatttataataaccaatacattacacccaaaatatattttatgcaagaaaaatcttaattaagtcgtatttatacataattaatacatttatgcatcaaaaagtgagtaatggccaacaaatgtgacttttgcggtcagatttgctatagttatgacgaaaagggtaaggagatgaatctcaatggcattaaaggtcaatcgccaaaacgacatggatgcgatgttcggcaagtttgccgaaatggatccggaagataaaaagcgtgataagttcttaaaacacgataaaaaagataaagataaaaaacgcaagaatgaagaaaaaccggaaaagaagaagagatggttctagtcagagtgtgactagcaacggttggggcggtttctaagggcactttgatttaaatccctggttttgggatttgaattgaagtgtccttagaagttagccccagttgcgtcggaacacgtttcgatcagagtgtgacgagggccgggagatgcgttttctaaaggcgctttgatttaaatccctggttttgggatttgaattgaagtgcctttagaagttagcatctgacccgtcggaacacattttaatcagagtgtaacgaacaactgcttaaggatccaccaacagcattctcaccactcaatccaatatatacacaatgaaaaacgaggcgccgctgattcagcggtgcctcgttttatttttgtcagaaaatatatatcatttacacaataactattcgccaagttccttcttggcatttttgatctgtagccgcacttggtcaaatccggtgccgccatatgaatgacgacgttcaactgccacctctgatttaaggtcgtgatagacgtcctcttggattttaggtgaagctgcctgtagttcctctaaggacatgtcttggaggttctggtgggtctcaatgccctttaaaaccagtttaccaacgatcccgtgggcttcacggaaggggatccccttggcagccaaataatcagccagttctgtggcattggaaaagtcattctcagtggcctgcttcatccgctcaacgttgggtttggcggtttttagcatcccgttaaacacttttaaggaaggcaataaggttttgaccgtatcaaaagtcccctccttgtcctcttgaagatccttattataggccaagggtaaagacttcatcgtagacaacaagccaattaagtggccgtatacccgaccagatttaccacggattaactcagccatgtccggattctttttttggggcataatcgagctgccagtcgtataagcatcgcttaattccagatacttaaactcgtggctgacccacatgctgatttcttcacagaaacgagacagatgcatcattaaaattgaactgttgcttaaaaactccaaagcaaaatcacggtcggaaacagcatccagggaatttggataaatttgaccgaaatccaactctttggcagtgtattcccgatcaatgggaaaagtcgtcccagcaagcgcggcagcgcccaaaggcatgatgtccgtatgcttcatattgaaagcaaaccgttccttgtcacgtttgagcatctgataataggccatcagatagtgaccatatgaaatcggttgggcgtgttgcaaatgggtatagcctggcataatggtctcaacatttttttcagccatctcaaccaacgttttctgcaacgtcgtgatttcatcgatgacttgtggcaagcgattcttcaagtataaatgaaagtcggttgcaacctgatcgtttcgtgaacgggcagtatgcagcttgccggcaacggatccgattcgctcggttaataaagcttcgatattcatgtgaatgtcttcgttttcaacggtaaaatgcaatttacctgcatgaaggtcctctcggagtccgttgaggccggcgacaatctggtcgacatcagccgttggcaaaattttagtgtgcccaagcattttgacatgggcaagtgagccctcaatatcttcatcggccattaactggtcaaacgaaattgaggccccaaattgatcaacccattgcgctgcttgttcttgaaatcgaccaccccatagtttcttagtactcatttatttcttagctcctgtatgtgcagaattgtgttcatgaaccgtcactttgtcctttaactgagacttggtaactgcttgaacgaactgtgcgttcttatttttcagggcaacttgttgataaacctgggttggcagtccccaaagcttgatgaagcccttggcagcttcttggtcaaatgaatcagaagaagtgtaagttgccagatccttgtcgtaaagtgaagaatctgatttgcgaccaagaaccatcacgttacctttaaacagttgcaatttaatgacgccgttaacgacctcttgtgatttatcaatgaatgcttgaattgaatccatcagtggtgagaaccacagtgcattataaacaagttcactcagttgtttttcaatagttggcttgaaatgggccaagtcacgttcaaatgttaagtcttccagctctttatgggcttttaacagcaccgttgcagccggggcttcatacacttctcgagatttgattccgactagacggttttcaatatggtcaattcggccaactccattttcaccggcagtttcattgagttcttggataatgtcagcaaatttcattttcttgccgtttaattcagttggaattcccttttcaaaagtaatttcaacttcagtgggggtatctggcgtattttcaattggattggtaattgcaaatgcatcttcaggggcactttgccatggatcttccaaaataccggcttcgtttgcacggccccaaatattggcatcaattgagtatggtgagtccaaatcaattggaattggaatattgtgatcctttgcgtattcaatctcttgctcacgtgaccagtgccaatcacgaactgggctcaacacttcaagctgaggatcgaggccgtggatggccacttcaaaacgaacttgatcgtttcctttgccggtacaaccatgggcaacggcaacggcatgctcttgatgggcaatttgaaccaacgtcttagaaatcaaaggacgtgacaaagctgaaatcaacgggtatgacccttcatacatcgcgttggccttcagagccacagcagcatagttgtcggcaaattcatccagggcatcgatgacgtaagccttaacagcaccaacgttcagtgccttttgcttgatgaaatcgagatcttttccttcaccaacgttaatgcagcaagcgacgacatcgtaacctttgtctttcaaccaggcaattgcaacggaggtatcaaggccaccggagtaagctaaaatgactttattattttctgacatatatattccctcttatcttctgaaaaattcaatgtattgagattaacaccaatattcatttaatgcaactgtttttatgttttattcattatttgtgaaaatattatgtcgaatatgcaaataagaggtcattttgccagaaattgctgcaaaaaaagcagccatctcaaaatgactgcttctaaattgatccttaaatattcacttgattaacgccacctgattgctcaggataacgtttttcgagccgtttgatgttgtcggtagcgacctcatcaaatggaatgtcggcccactctgagatttgggacaggtaccacaagacgtcccccatctccttaaccaattcatcatgatcgagcctcttgctttgaaaagtatatttccgaattaagtcagcaacttcaccggattctccggtgagtcccagtgcacagttagttaaaacctgctcgttacccatcagtgtccgattggctgccttttgatagtcatcaaaattcatcgtttcattctcccctcaatccaacgccaaatctcgtttttacccgtttttgtcaaagcggagaacaaaatgagtggttcataggcatccaactgcagtgtctttttgatcaatgattcctgcttgttccatttcccgctggagattttatccattttggtcgcaaccgttaacattggaatattgtaatacttcaaccaattatgcatcgaaacatcgtcgtcagttggcgcatggcgaccatcaaccagggtaatgaccccccgcagctgttcacgtttggttaaataggtttcaatcatgcggccccatttttcccgactggctttggatgcctttgcataaccgtatccagggacatccacaaagtacagcttatcttcgatgttgtagaaattcagggtttgagttttccccggctgactggacgtccgagcaaatttgttgcgattgatcaacacattggtcagggaagatttaccaacatttgaccgacctaccaatgctatttctggaaattgtgtatttggatattgtttttctgcgacagcactaatcgtaaggtcgacgttgtgaacttccatgaaaccactccttcaatgaataaaatgtgtgaataaaaaagaaatctgacagtaagctatctaaagtctacatcagatttctaggaattacgatgcttgttttaagattaattccggttccttatgatccgtcacagtctctggggtaatgatgaccttggagacatcgtttcgactcggcaggtcaaacataatgtcacgcatgacgccttcgatgattgagcgaaggccacgagcgccagtatcacgggcaattgcgagttgagccatcttctccaatgcgccaggcgcaaattccagttcggcaccatcaagttcaattaacttcttgtattgtttaaccaaagcgttcttaggctcagttaaaatgcgaaccagatcgtgttcatcaagcttatccaatgcggtcaaaatcggtagacgaccaatgaattcgggaatcaagccaaacttcaataagtcttctggaataaccgactgcatgatgtttttggcatcgaccttagcagcttcatctgagttggtaccgaaaccaattgtcttatcgccaaggcgactcttgacaattccttcaatcccatcaaaggcgccaccaacgataaacaagatgttcgtcgtatcaatttgaataaattcttgttgtggatgcttacgaccaccctgaggcggcacgttggcaattgttccttcaagaatcttcaataaggcttgttgaacaccctcaccggatacgtcacgggtaattgaaacattttcagattttttggcaatcttatcaatttcatcaatgtagataatcccatgctctgctcgttcaacgtcataatcagcgttctgcagcagtttcagcaggatattttcaacatcttcaccaacatacccagcttcagtcaacgttgttgcgtcggcaatggcaaatgggacattcaaaattttagccattgtctgagccaggtaagtcttacctgagccagtcgggccgatgatacaaatgttactcttttgaagctccaaatcatcatcaggttcgctaatcatttcgttaacccgtttgtagtggttatatacggcaacggaaagtgtccgcttggcattttcttgaccaatcacaaattcatttaacttgtccagaatttgagctggcgtcaaaactttgagtaaatcgtctgatgatttttcaggtgccaattcttcatcgatgatttctttacataaatcgatacattcattacaaatataaacgccaggaccagcgacgatctttttcacttgatcctgtgttttcccacaaaacgagcaagtaataggcccgcttgattcattatcttcaaacaaattattcactcctccatccgagatggactttaaatacaattagtagtaatcaactaagagtaactttaccatatcacatacaaattgcaattaatcggctttatccttaaaaaaagacccgtcaaaataacgggtcttttaattaagcaaaaagctatttttctgagctggcttcagttgaatccttttcagttgattttgctttggcgtcttgctttgatgaatcaacaatcatatcaattgcttgcttgattgcaatatcatgtttcaacatgtcttcagtcaaggcactgcgaacagcgtcttccttcatgccatattgtttggcaaggttcttcacctcagccttaacatcatcttctgatggctcaatcttctctttggcaacaattgcttcaagaaccaagttagtcttaacccgcttctcagcaccgtcagcaaattgcttcttaaggtcttcaggcttagttccagttaactggaagtacatgtcctggttgatcccttgttgttgcatgccagcaagatattgatccatttgacgttgaatatcttcgtcaatcatagcttgcgggatgtctttaacttctgcattatcagttgcttcactgattgcagcgtcttcgatggcatcacgagcttcagacttcttttgtgacttgaggtcttctttgatcttttccttcaattcatcaagactgtcaacatcttcgtcaacatccttggcaaagtcattgtctaatttaggcaattcttttgtcttaacttcatgaatcttggttttaaagatggcttccttatttgctaaatctttagcttggtaatctttagggaaggtaacctttacttcaacttcatcgccggctttgtgaccaattaactgatcttcaaagcctgggataaatgagtttgagcccagttcaagagaatggttttcagcactgccaccttcaaatggcttgccgtcaatgcttccttcgaagtcgataacaacagtatcgcccttctcagcagccttgtcttctttaagaaccaattcagcttggctttcacgcttcttttccaattcagcgtcaacgtctttttgatagacacgggtattttgtttaggcacactcaagcctttgtaatcgccaagcttaacttctggcttaacggtaacgttagctttaataacccaaggcttgcccttttccattgactcaacgttaatcttaggttggtcaactggttcgatcttagcgtcttgaacggctttttcatattcgtcaggcaagagaatgttgagggcatcttcgtacaatgcttcttcaccatacatcttagtgaaaatctgacgtggaacctttcctttacggaagccgggtacccgaatgctgttcttattctttttaaatgcacgatctaatcctgatttgattgaatctgtaccaatttcgaatgttaattcgccatcattggtacctttcttttcccattttgcagacatcttttttcctccgagaccaaaagaattttttacaatttcataattgcataacattgttattttaacgtattaatcataaaatgtaaaattaatttcaaacgaactaaaaacataaaaaaagctgcgaggaattatcctcacagcttaagtgtgtctaatgataaaaactagtcgttaacatcactaacaacaccggcaccaacagtatggccaccttcacggatggtaaacttagtacctttttcaatggcaactggcttagttaattcaacttggaatgtaacgttatcaccaggcataaccatttctacgcccttttccaattcgataacaccggtaacatcggtggtatggaagtagaattgtggacgatagtttgagaagaatggcgtatgacggccaccttcttctttagtcaagatataaacttggccttcgaatttcttgtgggtctggattgaaccaggagcagcaagaacttgtccacggacaacttgatcacggtcgataccacgaagaagaacaccaacgttatctccggcttgaccttcatcaagagtcttacggaacatttccaaaccagtaacagttgacttcaatggttcgtcgttcaaaccaacgatttcaacttcgtcaccgactttaacagtaccacgatcgatacggccagatgcaacagtaccacgaccagtgatagtgaagacatcttcaactggcatcaagaatggtttgctgtcatcacgttctggagttggaatgtattcatcaacaacatccattaagtcaaggataacttgttcttgttccttgtcgccctcaagtgctttaagagctgaaccacggagaacaggaatatcatcaccaggataatcgtattcagaaagtaattcacgaacttccatctcaaccaagtcaactaattcgtcatcatcaactaaatcagtcttgtttaagaatacaacgatgtaatcaacaccaacttggtgagcaagcaagatatgttcacgagtttgtggcattgggccatcagttgcggcaacaaccaaaatagcaccatccatttgagcggcaccagtgatcatgttcttaatgtaatcagcatgtcctggggcatcgatatgggcatagtgacgcttttcagtttcgtattccacgtgagcagtgttgatagttataccacgttcacgttcctctggagctgcatcgatatcagcatagtcttcagccttagcgagaccctttgcagccaataccttagtgattgcagcagtcaaagtagttttcccatgatcaatatggccaatagtaccaatatttacatggggttttgttctttcataatgttcttttgccattaatgaaacctcctgttgttttcaagaattacatcaatttcgcatcaatgcatttctaagtgttattatactacatcttctggaaaagacaaagtagtcaattttcgaagaatccttaagtattatatcgatactggtaatgtttgtaaacagattccctttattttccgaaaataattcagttatatgagaccaattttaatttcctgatcatgaatctggttgatccaagataacattctttgctgctgttgtgtcttggcgggcaacggctcaccaaacgattgggcaataattgcctgtgcccagaagttgggttcagtcatcacatcatcaaaataggggtaaatataattactctgagtgaataattctctttccagcaaatccaatttgattgggtccttatcagcaaattgttgctcaacaatttgaagaacacgcacaaaagcatcgattttctccaatggttttaattcgtccaaacttatcgtatgggtctttccatccaaccagatcaaatcaacgttttcagaaacttgagctttcattaattgtaacaagacctgcgttttcgaaacctgccacccaaacggatcattcagtaatgtcttggcggccgacaaatattcatttagtggcagatgaagcgctgcttgaacctcatgaacctgctcagtgacggaaagtgccccaagataggcaaatttacgtgacttcgccgccagctcggttgaatgctgttgacgataatcgttttcagcagtcacgattctttgcttccactcccccttctttgaagtcgatacctgggcaagcacctctcgggcagacatgaacagattgttggccaaaaggatctccatcgcatggccttgataccttggttgagcgatgaaactcccggcaaaatcggccacaacttgtccggcatcggcatatcttttcaaatggtacaacgcatttgcatacaaatcgttcaattccacggattgcggatattttcccaacaaatgctctgccttatttacgacctgattataacggccatcccgcaaatcctcttgagcactcaacaggatgacgcgatcgttttttatcatctcagtcatcttttcctccataccgtgtagagatagaaaacgagcaattcaaaagaatgaattactcgctcagttggctaatttttttcagctgctttttgctttttctttgaacgtttatggtgttggttaacttccataataactggtaaaataaccggtcgccgcttggtttgtttatacaggtaatcactcagatcctcgcgaacgtcctgcttaaggttactccaatcgaactctttgtgttcaaggttgttggtaaccgtcttttcgataatcccggcggcgtccttcatcaagtctttgttggctttgacgtaaacaaatcctctggatgtcaatttgggagtggacacaatccgcttctttttgcggtcaatcgtcacaactgctacaaaaatgccatcttccgagagtacctttcgatcgcgaaggacaatgttgccaatatcaccaataccgataccgtcaatcatggtatccgcaaggtcaactcccttgcccaaatgaatgtcatcttctgaaatcgagatcacatcacccttggcaggaataacgatttgatcatcagtatagccgatttctttggccagttgagcattggcttccagtaatcggtattccccttggactgggataatatacttaggatgtaataaattcatcagcaactgtaaatcagcttgactggcatcccccgatgaattcatctcatcagaaatcatcttgacttcgccatcggcacggtaaaccatgtcacgcgtcttggcaaccgttgtttccatggcagttgacggggttgtcgtgataaagaccagatcgccaggctcaatattaatatcactttgttctttattcgccatccgctgaatcgctttgattggttcgcccattttgccggtttgaatgatgacaactttatcaggggccatttttttaagctcgtccagtgagctaatcaacaaatcgtcttctggcagtttaagtgtattcaatcccatggcagtcttgacaatccgttccaggtcatggccggttaaatagactctgcgaccggttctggcggcggcattgaagacctgctgcattcttaaaatgtttgaggcgacaccggcgacaataatccggctgttttgataattgaaggtatcataaatatattctgcgatcttcttttcagaggcactgggatttgggttctcagcattgcttgaatcatcaagtaatgccaaaacaccctcatcaccaagctgggtcaacgctgaataatttgtttgatagattggcgccgctgtttggtcaaatttaaagtcaccggtataaacgatgattccatttgatgtatgcaacgcaatcccgagtgaaccgggaatcgagtgtgtcgtcttgaagaaagtaaccttaatgtcttcaaaatcaatttcactgcgatcactgacaacgtgaaagtcatcgaagtgcttaacttcttcagagtcggagacgttaattttagcgagttcaattgtcatttcagatccgaagacgggaacatcgaatttgctcaggaaataagaaattgcgccaatcgaatctgcatggccatgtgttaagaaaacaccgacaatgcgatctttattctcttcaagccagctaaaatcgggaataacaacgtcaattcccaacaattcattttccgggtattttagaccacagtccaaaatataaataccgccattgatatcgaccgcgtacatgtttttgccattttcgcgggccccaccaatcgccattactttgatttcgtttttcatgattcacctcaaaaattaatatgttcttttttacgttcgttttcagcttcttttagtttaacatattttttgttgaaaccgaatttttcaaaaaacattgtgctttcttaaaataattatgtataaaaaaagaacggatattatccgctctccttgatgttaatattaacgacgaagaccaagatccttgatcaattgacgataacgggtaacatccttgttacgcaagtatgccaacaggttacgacgatgaccaatcttcttcatgagtccacgttgtgaatggtaatctttacgatgagtacgcatatgatcgttcagttcgttgatatctgcggttaagacagcgatttgaacctctgctgaaccggtatcgccttcgtgacgagcaaatttgttgataatttcgttcttcttagtctgtgtaattgccataatgtataaccacctttttattttttgacgccaacaactgagtatgcggaagtggtacccgacaaactaagttgaaggtcttgtacaacacacaaaaaatagtataacggatttctctgacaaatacaagcttaccgccgatattcattgacagtttggcttgcaatcagtcgttggtttttgtataatgatgcttgttgaaatttaataatttttacttagaataatactcggaggtgagtcaaatgccaattatcaaatctgctatcgaacgtgttaaaactaacgaaaaagcacaacgtcgcaacgctgcacaattaagtgcataccgcactgccgttaagaagttccaaaaggcacaagttgccggttctgacgacgttaaagatttatacattaacgcaatcagcgcaattgatcgcgcaaaatcaaagggcttaattaaagctaacaaggctgctcgtgacaagtcacgtttaacttcaaagttagcaaaataattctttcctagttgttagtcagactaacaactttttttgtcccacaaaaataggagtaagcaaggtcgaccgactttgcttactcctattttttattaactgacacttttcataaatttcaacacaaatagttcaaataataattcgggtgggcgctgggttgatttcatctgacgttcagtatcaaccaggccaatataagcttctcgtaattgatcgtaattgaactttctgatcgtctgcatcgccaacttgacccgatacggatgcactttgagtgttgaagctaagtttccttgtgagtacccgtgcttctgcagaatcatgacctgcagcaacaatcgaaattgctgaattaaaacagcgttaatccgaattggttcatcattttccagaattaattgatgataaatgtccattgactgtttgggattcttcgcaaggacgctattaaccaagtcaaaaacgttctgctccatggacttgctgaccaatccattaacggatgcaagatcaatgactttcgtatcattgttgtacaaaatcaatttgggcaagtcactcatcatcgccgttagcttaccaccggttaattcgaccatccgatccaatgcatcgtgatcaattttgaatcccgcagcagcaatcttatccgtgaccagttttttaatctcattttcacgaaggtttccaatttcaatggtggtggcgacctttttcagggctttggtgactttctttctggaatccaatttgtcatacggggcaaagatcaccataaccgtggactcttcggggtgttttaaatattccaaaaagtcgtcgatattttgatccaatttggacttcgtacgcattccagtcaaaaaatacggtcggttaatcatgaccagtcgacgctcaccgaaaaatgggacagaaatggcatcctccaccgcggctgaaatcgtggtatcttccatatcgtaattgccaatattcatcgaacgctcgttgtccgggatgattttgacaaaagcatccttaattcgaccggcaagatactcctgatcccctaagatcaaataaaccggggcgaggtttccttggtttaactgttgaattaattgagaatagttcattataaattcccttcatgaccggctaacaccgtttcgaaatgaccggtattgtttcgatagatatatcttaccacaccgtgtttttgggtattaaatattttaacgtgatgctgtttcaatgtgacaagtgtttcgtcgtttggatgaccataccggttgtttcgaccggcagaaattaaggcgatccgtggtttgacggtagcaataaactgagggtcagaggatgttttacttccgtgatggccgactttaagaacgtctgctgacaagcccggatgcctttgaagcgtgtccagctctcctgggcggtccaagtcccccgtaaatagccaccgcaaaccgcctttttgagtaccgatcaccattgagtcatgattctcacccttaccggcaagatagggatgaaagatttgagccggcaaacctggtacttgcgtctcatcagtgacagggatcactttggtagatcgactgcggttggcaattctcttcataaaactggggttttggtccattcccaaaggaataatgatccgcttaatttccatttcttcaatgaatgccggcaaatcgccacaatggtccgaatcttgatggctcacacacagattgtcaatctttgagatgccaatacttttcaggtaattaatcgagagtcgcttagcttggtaggtttgagcacccttttgccatggctgagtattgaattgaaccttgccgccagtatcaatcagggttacagaacggttaaagggctcccgaatcaagaagctgtccccttggccaatgtcaaacatggtcacctcaccattgagcggaaaatggatccaacaatacgtcaccagataaacagctgccaagatgccaatcaatttgggtgcccgaacacgatcaacaacggccaatagcattgtcaccgccaacatgattaggacaatcggcaatgccggtttaccaaaggtcaacatccccggcaaacggctcactgcatttaacccatcattaaagatgtgcaaaaacatgtcgatcggcagaaccaacgtttccgcaaccagtccgacaatgacgccaatgataaccagcggaaagatgacccggccgaacagcggcaagacaatcagattaacggcaacacttaagaaatgccactcgtaaagatgaaataacaaaatcggcacggttaaaaaattgagcaaaatcgtttgcttaatgtatgaaagcttctcagaggcaattaaccccaaagacaatccataactgagttgaacccccattaaaaacatcgcctcgggtaaaagaagcaggttaatgattaatgacccgctccaaatgtccagttgggaaagaccgaatttaaacaaccgattaagaatgccaatgatggccatcatcactgccctcagcaatccgggggatccgccagagaagacaaaataggcgcctaaaaaggtgattgagatgattgattttttaaacctcgacaaccccagccaagccagcagctggtcgacaatcgaaagaaaataggccacatgcatccctgaaatactaaagacatgcagcaaccccagcttcttaacccccgtcatttcatcgaagaagttcaccggccgatacccactaatcaatccggtggcatagatccccagagttttgggcagctgactgcaatactggttgaatttcgaacgaataatatgaattcgatcgacaattgacagtttagctggtggcggcagaagaacgaaatggtcgaccaaaaagcaactttgaatcttttggtgatgataatatttttccatatcaaattgattcaggttggttgccggcaaaaaaggggctgttttcccactcaccttaagcatcattgggttaataccggctgctaaacgacgttgttgactactggacttcaatctggcatagaacaccatcttttgctttgcaccctcaggacgggcaataaagctcaaatttgccccgttcactttggcggtatctggatagactttaaccacataattttgctgtgcgactggtgcagagacctgtcgattggtcaaaagcccaccaaaggcaaagatcaggccagcaaggatacatgtactaacaaccttaacgtcccgcagaaaataaattcgcataatcagaatgcttaataaagctgccgcaatcagccggttcccgtacatggccatgctcatcaaaagcatgacgagtgccggaaaaatgagccagtttttattgataactagtcagacaaataggatccgaatggcactctatccatatcggcttgagttaacttaattttgttcaattcaatatttttcaacctaatcagtttttgggcgtaatcattattatggtaatttctgaggtaattgattttggtgattccagcctgaagtagcatcttggtgcactgaagacacggaaaatccgtcacgtagatttcagcattgtcagtgctttcaccgaacttggcgcactgcagaatggcgttcatctccgcatggatggttctcacgcaatgaccgtcttccaggtaacagccaacgtcaatgcagtgatcatcccccgcgacggatccgttgtagccaccggcgataatccgtttgtccctgacaatgactgctccgactgacaatctttcgcacgtgctccgtgaggccagtaaaaccgcctgcatcataaaatattggtcccatttaattcgcttatccattatcattccaccttctctggtgtaaatcatatctcaaaaacgctttttgggctagacgcaaattgatgccttcagattggcaaaggtcttatcaccaaacccagggacttccttaagctcctcaatgtttttgaattggccgtgtgcttggcgataagcaatgatctgatcggcttttttgtccccaattccggttagctcttggagcttggacttatcagccgtattcaaattgatctgttgagacgctcctgaagttccgtccgccgatggcgctgagttgtccgacccggaatctgctggagtctcagatggcgtggggctggccgcaaccgttgacgtgaccggtgtccccttctcaccacgaatcggtacataaatgacttgttgatcggtcagtttctgggccaaattgattttcttcttgtccgcagaccgattgtaaccaccagccaattcaatggcatcgactacccgcatattgctgctgacctgataaacaccgggattcttcactgcccctttaacgtcaacatacatttgttgattagtgcctgcagcaacttgcttgggttgatcaccaggcgatgaactcgcggccgatcccgtatctgaacttgcactggaactttggacagcaaccggttcctcggaacttgcagtttcaccgcctttaccaatcaacagcccaccaattacaaacataaaaacaacaatgactgctactaaaccaattagtatctgataaagatattcatcaataaactcacgtatcctatccatactgtgcctcccttctaaaaaatacatacgaaaaaaaggattagattatctaaccctttttgattttgcttattgatttttttctaaaattgagaccgcttgggcaaacgtcttaacgggaatcactttcattgatggggcatattttttcgccgttgcttttgccagttgataattcgtctggtggccttcctcatacttcaaaattgttttggttggcttcacatatggtgcaaggaaaattttcgcatcatgctttttagcagtgatgacttttttatcaattccaccgatttcgccaacgttgcccaacccatcgaccgttccagttccagcaactttttgaccgtgacgcagattcttgttggtcaactgactataaatctggagggcaaacatgagaccaccggaaggcccgccaacttgaccagggtgaaccttaattggaatcttaggcttcacttgaacatcatcggtcaaagtgatgccaatacctgcccgatgcttggcaatcatgccaagtggcgccgtggcttgatgcaatttgccgtgacgtttataggtgaccgtcagtttctgaccatatttttgctgcttaacatacttgatgaagcccaaggaactcttaaaatgatgcccatccaaagcaaccaccacgtcgccgaccttcagcttatttttaaagttggaatttttcatcaaactcatgacataaatgccggaatacttaatcttaacggctttatgggcttgatgataggctgtgtaaatggcgctattgatcgatccgtccatgtatatttgttggaccttactatactccttcatatcttggccaccggtcacgtcttcttccggctcaatcgaataatatgggctgagcttggcataaagataagtaaatggtcgggcttgagagatgctgacagacatcagcataaactgacctttctgtcggtcgggatgaccttggatgttcacaattttactcagattagcggcgtcaccaggtccctcaatgtatttgggaagcggccacaaaaagccgatcgccacaaaaagtaaaatggcaaaccaaattaaatattttttaacccactttttcattagttcaccactctctaaaagctattttattgttgatacttgtcattcaatgcctgtgcaacaggtcctggaacaaattttgatacatcgccatggaacttagcgatctctttgatcatactcgatgagaggtcgcgatagttggccgcggttgggataaaaatggtttgaatatcgtcggccaacttctcgttaagccccgcgattgacatctcggaatccaggtcactgccgccgcgaacgcctctgactaagaccgttgcgcccaaggaatgggcaagctggacggtcagctcttcagagaccacaacgtcgacattgggtaactgatttaatgcctggcgggcaaactcagcccgctcctcatcggtgaacaaagcatgtttgtgggtgttaatactgatagcaacgtacaccttgtcaaaaattcggctggcccgtttgatgacatcaatgtgaccgaaggtgatcgggtcaaaactacctgcatataaagcttttgtcattgcgcattccccatttgatagtcataaatcgtcaaatttgtgagtccataatttttttgcttggctgcgtgaaatccatcgagattgagcggcaattcagtgtggttatcagtttcacaaattaccgtcgccccttcagtcaatagatcgaggcttttcaattcttccaaagtggtcacgatcttttgaagcttatagggtggatccagaaaaacctggtcgaaccgatccccattggcagctaattgttttaaaaccatctcggcgttacctttaatcacggtaaactgatcttcagcgtgaattttggcaatgttgtctttgattgttttgatcgcttgatactgtcgatcaacaagcacagcactatccatccctctggaaacagcctcgatgccaactgctcccgaacccgcaaacagatccaagaaccgaccaccatgataatagggcccggtcatactgaataatgattctttcaccttatcagtggtcggccgagtttgatcgctcttcaccgggtttaagcggatgccaccgtattttcctgatacaatcctcatagtttacctcaactctaataatcttcgtcaaccgaatcgtcatcgtccaactcggttttaccttcaacttcttggaccaattcattcaaatgtgaagggaccacctgcttaacccaactttgagaagccaattttttagtaatctcttcctcatcatctttgttcacatagatcaaaccatagcgcatccgtttggagacgtaatacagtcggccatatgacttcagatttctggaatgacgaatcgaatgtaaataaacgattaacccggtcgtgggttgaacagttaaagccattatgccatctcctcaaatttaatttctggcagcgataagtgcttttcgttccatccgctgacgactactgatattcagtaccagtcccaaacaaaacgaaagggtcaaaatacttgaaccgccataactgataaacgggaaggtcacaccagtaattggcaggacccccaaaacaccacccatgttaaagaatgtttgaatactcatataagttgcaacgccgtagcaaaccaggctttgataagtatcgttactgcgaacaccaatttggactgttcgcaaaatgatcactgtcaataatgccaacacaatgacagccgtaatcgcccccagctcttcggttaaaatcgacataataaaatcggtgttgggctcaggcagatacccggttttttgaacactatttccgaggccgacaccgaaaaggccgccgttacttatagcgtaataggagttaaccacctgttgacctgtcccctgcgcgtgaccaaaaggattggtaaacgcgacaattcgttgcagttgataggaatgggagaacgaatccgatttggccattggtaccagaataaattcaaatgccagcacggcagccaccatacaaccataaatgattgccaaagctcgtttccatgaaaagccactacagttaaacagaataaaggcaattgccaaattaatggcagcaccacctgaatcaggctgcttgagaatcaacgcaatcaaaacggcggtaaagaacaacggccatttcatgtgattccaccagtcccgaaaagacagcgtgatctctggttgagccttatcaattgtgtcggcaagccaaatgatcaaaaagaacttcacgaactcggccggctggatgttaattggccctaagtgaatccacccagctgcgccattgatggttttgccaactaacagcagaccaatcaaaacaacaatcagagcatacagtaagaatttcaaaaatttgggtttgcgtaagtacttaatgttcattgccgtcatcacgccaacaataataacactaaggacgacaaagaataactgcttgatcaggtaactcagcggactccccccgttctgcagcgaaatatttgcgctggcagaatagaccatcacaacaccgataatcgacatcacaatatacggaataaaaataacatagtcgagattttttaaacgtgctttccccattggtccaactccacttttcaaattatatgtaggtgcatcgagctttattatatcataattaaaaaaccggattcagagattgctaaacggtttaggggaatttaagaagttacaacaaactccattcaatacaaaagagcgtgggacaataagcggttagcttccagaatataaggggattacccgaacatccagaacttggatgtttgggtaatccccttatatggccggaagctgcttattggcgcacagttttgctagataatattcaggcgcaaatagaggctggaacaaaatttttagttttgtcccaacccctcctgatgatttactgattttagttatgacgcttctttttagcttctttttcacgggtgtttgagttcaaaattttctttctcaaacggatgaagtgtggggttacttcacacaattcatcttcattcaagaattcaagtgattcttcgagtgaaagatgagttggtgtcttaatccgggccatatcatctgaaccggcagcacgaacgttggtcaggttcttacctttggtgatgttaacagtgatatcattctcacggttgttttcaccaacgatcattccttcgtagacttcggtacctggatcgattaacaatgttccacggctttcgatacccatcattgcataggtcgttgctttgccggcgttcattgaaaccaaggttcccttggtacggccagggttccagcccttgataactggcatgtatttctcgaaagtatggttcaagataccatatccacgggttaatgacaggaattcagttgaataaccgatcaaaccacgtgatggtgccaagaatgtcaaacgagtctgaccattgtcggttgtttccatgttctgcatggtacctttacgttgtgaaagggtatcaataatcgaaccggtatattcatccggagtatcgatttgaacggattcaaatggttcgcacattgtgccgtcaatttctcggtagataacttctggacgtgaagcttgcaattcaaagccttcgcgacgaagggtttcaactaaaattgacaaatgcagctcaccacgaccggaaacaatccatgacccgggttggtcggtatcttcaacacgtaatgaaacatcggtgtgaagttcacgcttcaaacgatcacccaattgacgggcggtcacgaatttaccgtcttggccggcaaatggtgaagtgttggtaccaaaggtcatttgcagtgttggggcatcaattctaagaattggtagtggctctggatctttaggatcaaccaccgtttcaccaacgttgatgtcttccattccggaaacggcaatcaaatcaccggctttagcggactggatatcttccttcttcaaaccgaagaatcccattaatttggtaactcggaagttctgcttggaaccatcaagtttcataacagtaacactgtcaccaaccttgattgtaccgcggaagattcggccaataccgattcgaccaacgaagtcattatagtcaagcattgcaacttggaattggaggggttcatctgaattgtcaattggtgctggaatgtctttaacaatggtgtcaaagattggcttcatagtatgttcctgtttgctgatatcaggatcataactggaagttccgttcatagctgacgcatagacaactggaaaatcaagctgttcctcgtcggcaccaagttcgatgaacaagtcaagaacttcatccacaacttcttgaggacgggcaccttcacggtcaaccttgttaatcacaacgattggggttaagtgttgttcaagagctttcttcaaaacgaaacgagtctgaggcatagtgccttcgaaagcatcaacgacaagtaaacagccgtcaaccattcgcatgatccgctcaacttcaccaccgaagtccgcatgtcctggggtatccaggatgttgatttgtttgtcgccatatcgaacggccgtgttctttgacagaatggtgattccccgttcacgttcgatcgcattcgagtcaagagcccgatcctcaatttgtacgtgttgatcaagcgtatctgactgcttcaacatttcgttaaccagagtcgtcttaccgtggtcaacgtgggcaataatagcaatgttacgaatgtcgtcgcgtgtttttaatttagtatccaagtcgtttgcttcccttcatttaaatcaaaccgaatattgtacatcatattattcgcataaaaaaactgtgacaactgtcacagtccgatcattgacttacaattgtaagaatgtcttgatgtgcatttcgtgttgctaacaatactggtgttgatgataacacatctaatcgctgtccgtcaatagttgtcatcttaagtccggcagtttcgcacagaattctgcctgccccaaaatcccagggcttcagataagaaatgtatccaaccaattcaccacggagaacggaaataatatcaattccagcactgccataaatgcgcattcccaaagactgttgggcaatgtctaccatattgtaatcgttgtgaagaaccatcggcccacttaggccaattaacccttctcgaagcgatgtgtccttgaccggcggcagcgggtggccgttgtcaaatacgccgatatccggtccgccagacaacaaatgcttaccaatgacgtccattacatagccaaggaggcctttgccgtcctcataaagggcaatcatgatagcaaaatgattccgctgcttgacaaagttcatcgtcccgtcaattgggtccacaatccagatctgtccttctgttgaatgaacctggtcgccaaatccctcttcacccaaaatcttggcgttggagtcaaattcacggattttaccgactaaaaacttttcattttgtttatcaatgttggtcaccaaatcacgtcgactggtcttagtatcaacttccagtcgggtgtcaatttttcttagaacgttgtcccgtgactcatgcagccaacctttaaccgttttatcaatttgtttgagttcgttaatttccatcctatgcctcacgtaccttcaaattagctgcctgcccatccttggaaagcttgatgacttcgtaggaatcatatccggaacgattggcaaattccttctccaattgtttctgttccattttggcagggaccacctcttggaatttccgataagctttgataaagtctgctcgtttaatgccttcagcttcctcatacgccttttcaattgcctcaaaaaaattaacaacgtcaataatttcatcaacatccaaaccatcaattagtgggtactcatacccctcggccatcttcttcactccgatcattaccaagttgactttattatatgatagttgaggactttgtgaaatagaaaaggtcgaagttatgtgagtttttcatttctcggaggacttaacagatcgtaattctggataaacaaaaggatccaacgatgaacaagcttcattcatcattgaatcctttattccggaattaaccggattaattaaaacagaactttttaaatatgagttgggaatcctaatccaacatccgcagcttcttgaactggttcgctcaaggttgggtgtggatgaatggtcagggcaatatcctcaacattcatgtgactgttaactgctaaacttaattcagcaaccaaatcactggcacctggtccaacaatttcgccacccacgatcgtcttatcgtctttggtgaagatcaaacggacaaatccgtcggcttcatcaagtgatacggcacgcgcattacctgcgaatgggaacttcgaagtggaaacttcaatgttcttatccttggcttgggcttgagtcataccaacaacggcgatttctggatctgagaagcagactgctggaacgccaacataatcgttggcagtattcttaccggaaattgcaccggcagcaactttgccttggaagaatgctttatgagccaatgcaggacctgaagcaatatcaccaattgcgaagatatgctcagaatcggttctgccttggatatcagtttggacaatgccgtgatcgtccaacttaaccttggtgtattccaagccaagatcatcggtgttaggacgacgaccaacagtgaccatgcagtaatcagctttgatagtggtctgcttgccatcttcttcgtaggtaacagacacgctgttgtcatcttgacttgaagaaattgctttggcactggtatgaatatcaacgcccttcttcttcaagttcttaacaactaatgaaaccatgtctttggtaaatccattcaagatggaatccaatccttcaatgattgttacatgggcacctaagttagcgtatgcaccggctaattcggttccaacatagccaccaccgataacgacaaattcttttggaatttctggcaggttcaagccgccagtcgagtcaatcacccgaccgtcaaacttgaaaccagggatttcaattggatgtgatccactggcaatgattaagttgtcaaactgaatcgtggttccggtatcggcactcatgaattgttgtggtcctgtaggcattactcgtaattgagtatcactgtcaagaacagcttctccatgaatgatttcaactttgtgcttgttaagaagcatcttaacaccactggtcattcggtcgacaaccttcttttgcttccactcttgggttttcgcaaaatcgattgtagctggttgagttgtaattccatacgtcgaagcatcgttagcttcctgcagacgatgcccagcagcgatcaaagctttggaaggaacacaaccaacgtttaaacaaacaccgccaagtgtatctgatttttcaatcagggttactttttgtcctaattcggatgcacggattgcggcaacgtagccaccagggccagctccgataattactgtttctttcttttcaacatcagccattattcgatcatccttccatcaacagcattgctggatcatgaagcaattgattcatgtaattcaaagcattttgtgcaagggcaccatcaattaatctgtgatcgtagctcaatgaaagtttcagcatattgcctactttaatctcgccgtcttctggatcaacatatggttccttggcaatcttaccaacacctaagatagcaacttcaggttggttgataactggtgtgaaccagccaccgccaattgaaccaacattactgatggtaattgaaccacccttcattgtatctgggccaagcttattgtcataggcagcttgggtgttctcggtaatttctttagcaatctcaaacatacccttggaatcagcatttttgatgtttggtacgtacagaccgtggtccgtgttggttgcaataccgacattgaagtaatgcttgtaaacgatttcttgagtggtgtcatcgattgaagcgttgaactcaggatatttcttcataacggcaaccaatgccttcacaatgtaaggtaagaatgtcaaatgaatatcttggtcggcagctgcttgcttgtacttcttacggttagccattaatgcactaacttcaacgtcgtcaaatgaagttacgtgaggcgcaatgtccttagatgtacgcattgacttagcaatgatcttacgcattggagacattggttcacgggtttcaagatcaggttgatcagacttccaaggtttgatagcttgacctgcggcagcttttgcttcgccagctggtgcagcagcggttgcagcggcagctggtgcggctggagcggcagctggattgaagttgtcaatgtcagctttggtgatctgaccatgatttcctgtggcaggaacagcagtaatgtcaacgcctgtgtcacgtgcatattgacgaacagatggcatcgctttgacaattgcgtttggatttgaagcagctggtgcagcagttactgcggctggagcagcggcaggtgctggtgcggcagccggtgcaggtgcttcttctttagcaggagctggagcagcttcttcttttgcaggtgcagctgctggtgcggcatcatcaggttcatcaggagaaccatcatcaatgacaactaaaacgtcgcccttttctgcggtttctccttcctgcttttcaatactcttaatggttccggcaactggagatggcatttcttggacagacttatcgttttgaatttcaactaacggatcgtcttccttgacggtatcgccaacttttacatcccaggtagcgatttcaccttcagtaattccttctcccatctctggtagtttaaacttataagccatgggatctaacttcctttctgtaacaaattagaattttagtagttcaaaatttctcgtactttagcttcgatatcatcagcatttggaagccaatcattttcagccatagcaaatgggaagatactgtcaggagcagaaacacggccgattggtgcgtccaatgacataatgtcgttttcagcaatgtctgaagcaacttttgctccggcaccagccatcttttgtgcttcttgggcaatcactactttgtgagtcttgtcgattgaagcaaagattgtttcatcgtcaattggtgataatgaacgtaagtcaataacttcaactgagatgttctctttttctaatttatctgctactttaagtgcttcgttaacttcggcactgtaagcaacaacggtaatgtcagatccttcacgaacaacatttgccttgtctagcggaacagtgtagtggccatctggaacttcatccttcattgaacgataaagtttcaggttttccatgaataataccgggtcgttgttttcaacggctgagataaccattcctttagcgtcataaggatttgcaggagttactacccgcagtcccgggatgccaatgaacaagttttcaagtgagtcaccgtgaagttcggcagtatgagtaccaccaccaaatggagttctgattgtgatcggcatcgtaacgtcgcccgagaaacggaatcggttacgtgacatttgaccaccgacagaatcaacagcttccattgtgaatcccataaattgaatttctgggattggacgccaaccggttaatgcaagtccgattgacattcctaaaattcctgattcagcaagtggggtatcgaatactcggtcttcaccatatttatcttgaagtccttcagttgtccggaacacaccaccgtttttaccaacatcttcaccaaaaatcagagtcttgggatcgtcttgtaatacttggtcaagtccgttggtaattgctttaatatatgtcattttagccatgattacttcgactcctttgcttcgtatttcttaatgtcagctgctacatctggggttggaacttcaaatgtgttcttcaagaagtcactaaccttttgcttaggagcagcttcggcatccttcattgcttccttgaattcatctttgtattgagcaactaatttgtcttctttgtcttgatcccaaagtttcttgtcagtcaaaacttttctcaaacgaattagtgggtctcggtcgaaccatggtttttcttgttccttagtacggtaacgactaggatcatcaccggctgaactgtgggcaccgaaacgataagtcaaggtttcaactaatgctggaccattgccggcaacaacaaagtcacgagcttcttttgcaaccaagtaagttgccagaatatccatcccatcaacttgaacaccaggaacaccggaagcaacacctttttgtgcaagggtttcagcagcggtctgagtctttcgtggaactgaaattgcccagccgttgttttgaacgaagaatacttctggagcttggaatgaactggcgaagttgattccttcatagaagtcaccctgtgaagtaccaccatcaccggtaaatgtgtaagcaacggtatccttctcaccgttcttcttgattcctaatgcagcaccagctgattgaacatactgagcaccaataataatttgtgggataaatgcacgtacaccgcgtcgtacgtagtcataagcttggtagtgaccttttgaccataagtaaccctctttaacggttgcaccgtgttggattaattgtggtaaatcacgatatgctgggaataggtagtcttgtttcttcattgcgtgggcaatccccatttctgaggcttcctcaccgtaagtaggagcatagaaacctaatcgaccctgacgtgaaaagttcattgtttgttcatgcaatgcacgttcccaaaccatcttttccatcagcgtaactagttcgtcatcgctgaattggtcaaataattcttgattaactattttaccgttttcatcaataacttgaaccggtttcttatatggatcgctcatcgttgatttgatcttggcaaaatcaacaacatgcttactctttgctgccatagataacactttcctttcctgtaaagctagacttgtgatgtacaaactgatcacttctaaaccacaagttaaatttagcatttttcagcaacgtttgcaagccctttcattgtgatgaaaccaacttttttgaatataattttcacttgacaaattttgggttgaaaccgcttgcgggagtatactttgtgaaatttcacccactttgtgaatagtgtttttttcttaaaattaagttagaatagaagttattcaattaatgcttaaaatattttcggaggtctttagcgtgtttttaatgaaggatattgtacgagatggagacccggttctccgtaaacaagctcaaaaggtcaaattccctttgagcaaagaagataaacaactggctcatgatctgatggaatatctggaagtcagccaggatccggaacagtgtgaaaagttaggtctgcgtgcaggcgtcggcttggctgccccacaggtcggtgtctctgaaatgatggcctcagtgttggttccaagtgaagacgaggatgaaaaagatgaaccggttttcaaagatgtcattattaacccggtgatcgtgtcgaattcggttcagcgtggcgcattgacagagggcgaaggctgcctgtccgttgataaggacattcccggctatgtccctcgggctgccagaattaccttaaaataccaagacgttgacggcaaagagcacaaggttcgattgaaaaattacccggcaattgtctgccagcatgaaatcgatcaccttcatggaacactcttttatgatcacattaataaggacaacccatttgccaaaacagatgacgaaatctttgtgtattgatcggtgcactaaatcagttgttcatatgccgatctaagaaatttcaataagcatccatattaaaaaatcgagcaaaaggaaaaacttttgcccggtttttttcttatccaatttaattgtggcgagtggcctttcctgaattagatctgtttggttatgccttgtgaacaaatatcaaatgaactttttgtaagttactggttctttttcattgaatttgtaacaaaccgttttacttatagacatattacccgacaaactcaacttagagacgctgacgatcagccttttgggtggcatgatcagtccttggcatctggacgtgcataaaagctggcattgtcaatccggtgacggcaatcagagccatcccagatatgatgaacacaattccgcttggaatctgttggaagacaaatgaataaaagacggtttccaaaggaattgacatcatattcaaagacatttcggtagacgagactctgcccatcagttcagtcggaaccgttttttgcatgtaaataccaaaaggcgtgttcataaaagccagtgacatccccactgcaaacaacatcaacgagcccaccaattggaccactaattgttcgggagcagccatcaataaagcgccaactccagccaaccccgtaccaatgatgaccatcgtgacagctaatatttttgccaagtgcctcaattctttcgagacactgatgatcaaattcccgatcagcatgccaagggcgtcggcggaattcaaaatccccagcgtcacgtttcccaaatgtaaatgttccacaatcataaatggcaggccaacgttaatgaccgcaaaaataaaattcaaaaacagggcaatacagatgagataccgtaaaaagtcgtgggccatcaaataatttaaccccagtttgaattttgcccactgggattcctgcggtgtctgactgcttttccttggatagctcaaataatgaaaattcatcgtcaaaagaattaccaaggcaatcacgtgagcagtcagctgaaagacgataaacagcctaaagccaactatcacatacaatccggcagccacaatcggcgaaaaggtcgaggcaaacgatgccgcagattggctcaaagaattcaatttttgaatatgaccctcgttgactaattcgtgaaccgacgccatgtagccggaattcgaaagattgacagatgcgtaattgatgatcaaaaacccaatcgttgggattaatttaccactgccatcgaagtgaccaattgcgatcgaataaatcaatagtgcgccgatccggacgaccagactaataatcaagagccgtttgtggggataagtgtcgaccaagttgccaatcggcaccaacccgatcaaagtcacaatcggcatgataatcattgagagtccaaagcttaacgacattcccgtcgcccgcagcagcatgagccccagagcaaatgaaaacatgtcaccacaaaaagtactggtgaagttgctcgatacatcttttataacctgcatatttgactcatgatcactaatttccattgtcagcacccgctttaattttgattaactgaagcctactaccattattaaagcgatagatgtaaaatgtgttgcatatatgccacattcaaagcttgggaggcaatcatgaaaacaatcgggcagacagtcaaaatgattcgacaaattaaaggattcacccaaagcgaagtgtactcaggcgtgatgtcacgttcatttgctcatcgctttgaaaatggggagaacgacatcagtgccgccaagttatttaaaattttagataatctgtccatttcagccaacgaattccgttttatccaaaacgattatcacgaacccactgcaacatccctgaaaaggcgcctgctacgggcctataacggccacgatcttcaaacaatgggccaaatcatcgctgaaacgcaaaaaagcagccgactcagttacaaatcggttgctgctatgggtcaaatattggtcgtcacttattattcaaaaacattcacagtcactccggcaatggaaaatctctgggacaccctttttgcatcacagacctggacacttgaagaaattaggcaggcccaaattttactgccaattgcggtcagccggcatcaagaagcgcttatttccgagattgttgacagatttgaaaacaactgtcgacaataccttcaagcagtggatgacccatttcatattgctgatgaattaatggatctttatctttctctttttcaaatcgagctcaacttggctcagtatcaattcgcaaaagaaattctaaacaaaatccgtcaggtcaacaccctggatttaagttggaatggccggttccaacaacaattgatcaccgcggtctggcagctctattttggcagtgagaaaaaaggcctggcactgattgccaagctggtcgctgttgaaaatctctattccccgacagtggatcataatctgcttgcaatcatcaaagtacgcaagcgactggccaaacagtatcgaaaagcaaacgccgttgactagtccataatggttcagtgcagccgctttaagtcatccacatattcaatcgtcgtcacgttcaccaggtaggcaacatcaaagtgcacccgatcatccagctgccagacatcggtgaccataaacgccggccgatcagcctgatcggtatgcgcgtgcatgtggtgtgtatcaccgtattgctcaagcgtcgttgccaaggcctttcggaaatcgggaattgaactttcaatttttgccttgggcagatgatattcaaacgccatcacacctctgccccacacttcggcaatatcttcagatttaaaatcactttcatcaaagggcaaaactgccttttgttcaaccagctggttaatcgaagttttcacggcttcattggcaatccgctgtgccaacgccagccgttttctgccgggtctcgttacaaagatataatgaatcaaattgtaaacagcaaatgctgcgaccaacccgatgataatttgaataatcaaatcaatgttcataactgagccccatttcttttcattgatttaattttaccatgcaatggtgcgagttgattactttcatgtttatatacttattttttagattatggtagaatatcgttattagttgtgttttcacaaccacttgtccgtaaggaaacctcgagtttctgcaaaaaaattgtataattttaaaggagttttttttatgatttggaaggttttatatcaacccagcaagaaggaaagccctcgccgggaaacgactcattcactctatgttgaggccgacacagaggttgaagctcacgcgttagttgaagacaatactgattatgatattgaattcatcgaacccctccaaggaaagcacttggagtatgagcaaagtagtcctgattacaaagtaacggagtttaataataaatgaaaaaactaaacgtcaagaataacgaagcagctatctatggcgttggtggtttgggtgaaatcggtaagaacacttacgggatccagtttcaggatgaaattatcctgattgatgcgggaattaagttccccgaagatgatctcttaggtgtcgattatgttatcccagactatcagtatctggttgaaaataaggataagatcaaagctttggtcatcacccatggtcatgaagatcatattggtggtgtcccgtatttgatgaaggttttaaacgtccctatttatgccggaccacttgcgatggcgctgattaagaataaattggaagaacacggcttgctaaattctgtagaattacacgaaattagtgacaagtcggttctcaagttccgaaaaatgaaagtttcattcttcagaaccacccactcgatccctgatacggttggaattgccgttcatacaccggtgggcgtgattgtggaaactggtgattacaagttcgacctcacaccagtgaccaaccagccgcctgatcttcaggaaatggcccgtttgggtgcagaaggcgtcctttgtttgatgtctgacagcaccaacgctgaaaagccaatttggaccaaatctgaaaagtgggttggaacttcaattgcccacatttttgataatattgaagacagaatcatctttgcaaccttcgcttccaacatttcacggattaaaaccgcttgtgataatgccatggcccacggtcgcaagattgccgtctttgggcgcagcatggatgcagcgatagtgaatggacgcgaattaggttatctcgatattcctgatgatgcgtttgttgatgcacacgagctgcagtcactgccagctaacaagactttgatcttgtgtaccggctctcaaggtgaaccaatggctgccctttcacggattgccaacggtacccaccgccagatttcaattcagcctggtgacacggttatcttttcaagtaaccccattcctggtaacacgaccagtgtcaacagcgtcatcaacaagcttgaagaagccggcgccaatgtcattcacggtcgggtgaacaacattcatacttccggacatggtggtcaagaagaacagaaattgatgctgcgcttgatgaagccgaagttcttcatgccgattcatggtgagtacagaatgctgaaaattcatactgagcttgccgaacaatgtggcgtgccgcttgatcacagctttatcatgcaaaatggtgatgtacttgccctttcaaaagataatgctcgtatggctggtcacttcactgccggagatgtttacatcgatggtagcggcatcggtgatgttggcaacgttgtcttgcgcgatcgtcaactgctttctgaggaaggtattgtcgtggttgttgcaacaatcaacttggccaaccaggaaatccaatccggtccagatatcttgtcacgtggcttcgtctacatgcgagaatccggtgaacttttggatgaaggccgacgccgtgtatttaagaccattcgaaagtcgatgcgtgctaaaaaagcaaccgagtcttcaattagaaatgcgattattgatgatcttcaagaattcctttacgacaagaccgaacgccatccaatgattttgccaatgctcatcatgaatggtaaagattaacaaaactgaacgtgactaattcgaaaacttgagaagcggatagattttatattcgattctcaagttttttacataaaaccatctgagttgggggctcattcaccaatgaaatatttcatcattatcaatttgcatgccggtggtgctaacgccaaaaaggtttggccggatatccaaaaacaactggcggctgcacatgccgattatcagacactctataccgcctacccaaatcatgctgttgaacttgctgaacaagctctcagtgaaattgacaccgccaaccaaactgacgctgtgttgattgccgctggcggcgacgggacccttcacgaaacactgttgggctgccagcactattaccgcacccatcaaaatgatcatccagttccaattgcctttttgccggtcggttccggaaatgattttgcgcggggattaaagattcctttgcactgggagaaatcattggctgacattttgacccaatcagctgctaaaaccatcaatgtcggccactacacagaccttgatcatcattccgaaggcttcttcaccaacaattttggcatcggctttgacgccactgttgtgcacctcgcaaatcattcttctttaaaaagtcaccaattcttcggacaattttcatacatggcggctatattaaacgtgatcatccactttaaagggttcaagaccgaaattctcccgggaaatatgcctaaagtcacattcgataacacatttttattaaccacaacagatattccttatttcggcggaggcatcaacatcgtgcccagcgcatcagtgttcgacgaccatctggatttagtagtggtcgaaaaaaccagcctttggcaattgattttatttgtatctatgatatttttaaagagacacttacggcttaaatttattcatcattatcatgaaaaagagctgtttataaaaacaaatggtaatcgtttgggtcaaatcgatggcgaagaacttggcgaacggacttttaacctgaagctcgacacggttaaatatcccttctggattcggtaagtttctgtaccgcgaaaaactaacgacgaggtaattctatgtattccaccagctaccttttatttcaatcattaacagcagttgccctgggtgacgcgcttggatatccgattcaacacgatacccgcctgaaccccttcgatgatccaatccatgagatggtcgaacaccggacgaatcaaatcccagccggcacttggtctgatgatacatcactatcaattgcttctttagttagcttaacgtttggatataatctttatgacctcatgacacgttattcgcaatgggtccattttggtgattacacgccctttaattatgcatacgacgttgatgagaccaccaaagcagccatccaacgctttgataccggcaccccaccggttttgtccggcggcactttggattcagacaatgacaatactgcccttaaacggttgatgccgttggccttttacattttaacgaagaaccagcagtacacctttaatgaaaccattgccgacatggttcatgattacacggctaccaccaaccgaacccccaagacatttattggttccggggttttaaccaacgtcattatccgcctgattcaaaatcccaacaaatacgccatgctaagggccgttaaggaagccctggactattaccgctcaaaagatcaattcgccgctcaggtgccgttttttgagcaattagaggagtctcacttcctccgacagtcgagtacgaagctaaggccctccggcgatgtgatcgccaccctcaacgccgttttctggtgcctgatgaattcggaacaatataacgttgccgtgtcaaaggctgtcaatcttggcagtaacgccgatactatcggttcaattacttccatgctggcatcactgctctttgcgccggtgacgttccctgaaaactggctgtcaaagctccagggaagaaatcagattaaaagtgcggtgtcagtggcgttactatcggacaatttctgaagtcgggtggctgttgcccattaaaattcaaaaaataaaaactgaaagccaaaacaaggcagataacgatgagtgcattcaccgttatctgccctgttttggctttctgtggaccagttgggcacttgattgtaacaaaaaaacggcaccgtcgatagacgatcccgcgtccacacgacctagtcttccgaagcatccattgcttctaagatcatgtttaactgcatgcattcttcattcaaatgcgtcatttcgtttccaaactgtggtgtgattacttcggtagaactcgtattcactggggtagacttgatcttgtctgcttcttcggactttaattgatcaagcttcgaggatgccttttggtattctctcagaatttctaacttattactcatagctataaactcctttgaacatgaaatttgaatttcgaatcgtcaatcctgatttctaacgtgggaatgttatcaattttttaacatttcctgctaacgtctggatatactaccagataaaattcgagaaagcaacaccctactcgcaaaacagtttggaagaaaaattaaactaatacttaagcaaaaagcacgttggtaaccagcattcagtgttggtcatcagcgtgcttttgtttattataaattaaagttcaacgccgttgacaatgtaatccggcttatcgcccttgtccattgccacagtattcttcgcaacaatctcagccatggcatcacgtgcttcaacagttgcgttaccaatatgtggtgttaagatgacgttcttcaatgctttaaagccatcgtcaacttttggttcggcttcataaacatccaggccggcaccggcaatttcaccgttttgcaaagcggttaatgatgcggtttcgtcaattagcggtccacgggcagcattgatcagcattgcgctgttcttcatttctttgaactgctcagctcctagaagatgatgggtttctggagttgccggggcgtgaagggtaatgacgtcggcgttcttgacgatttcatcaacggtggtaaatttagcacctaatttttcttcggttgctgaatcaagttgatgacgttggttgtagagaatcttcatatcaaatgcgtgcattcgtttggcaaccgcctgaccaatttggcccataccgatgattcccaaagttttgcctgcgagttcgtgacccaagaagaacagtggtgcccagccagtgaagcccttggtccgcatgagttggtcaccttcaacgactcggtgggccaaactaatcatcaaagcacatgtgacttccgcggttgaagtggtcgaaacctttggtgtgttggtcactggaataccctttgatttggcataatcagtgtcgatgttattgaatccggcaccatagttggcaatcagcttgaggtttggggcggcgtcgattacatcagaatcaactttcgtggaaagtggtgtgatcaagaagtctttgtcagcaacccgcttgctgagttcatccttggtaatcagattttgactgtcatcaaatacatcaatgtctaatccggcatccttgagaatgttcaaggcatgctctggaattcgacctgcaattaaaactttagacataaactcactccctaacaaatatttcatacaactccattatagggcatatcagggttgtatgaaaccgcttttacgagtaatgctatcaactgattaactgaatgacagtgacaatttggtagggaaaacccatgttgttttaagctaaaatagatcttagaacgactatacgttaaaccattgttatatgcattaatcctttgatcggtttcgctgaaaaaaccaggtaacaattgaaccaattaggataacgacgcctataactaagaaaataaggttcataaccttatcaactatatcagcagtccccttataaagggtgtatccgctatctgcgacgatccaaatgccgattaatacgctaagtaatagcccaaccaccggaacaactccagctttcattttctttttcatacgtaactcctttcaagttgtttgggaagtggattatgtaatatggtgacactagagggttgtgcacttcatctagggtcaccatgccgaaattattgttgtaaaggttctgaatagcttacatatgaggcgcctttttttctggacgtatatttgattccttcacctataccataggtattccaaactggtgccaaagaaaattttgagcttccaccagaagtatttgctaacacactgttggaaagagttgatgtgttggtaaaggtcggaccaataagtttcattttaataacctccttaggctaaatgacttccttctttgaaacccttaccaaaagcatctctgtgcttccactcggagcgtgcaagccctatcatgacggttgtccatatattgccaccggataccattgctagtttctttgacgaaataggcaccacgtttaaagatgtgagtttatcaaaagtattttgactgtgattcatgtttgtcgacctccatttgttcgatttgccaaaaatctcgcgagaactttatgacatctttaggatctcatcaacatcgtggaagttcaagctgcaaattatagacatggcgataagtgaacgcgtttatttcaaaaattcaaagaataattgtcatatgaggtttgaaaatcatattggattgaaatagattaaaatgccgataatacatgcaagtaggaagattacccatgtgatcgtgatgtagataccaacatgtccatgggaataatatttggtgctgtcaagatttttattctgcattatctacttttcctttatcaagttatagtatttgtttctgttgcgtagtaattgggaatgagtaccactttcaacgatcgttccattatccatcacaatgatgcgatctgcagcctgtgcgacttccaatctatgtgcaatataaactattgttttgtttggaagtgatcgcaaattagtgagtattttcttttcggtcaatacatctaagttgctagttgattcatcaaatactaacacctttgcgtcgcttattattgcacgagcgattgcaagtctttgcatttgtcctcctgataaaccggtgtcttctgataagatagttagatatcccttaggaagccttttgatctcttcatcaatttcagctaattgtgcagccttttttacttgggcaagggttttatcattttttgtcccaagtaaaatgttatcgagtaccgaacctgaaaatatatacggcgtctgaggattatatgcaatatatttccgcaattctgatgttggggcagtagttgtactatagtcattgatcatgatagttccagtcgatggtaaataaaattttatcaataattttagtagagttgttttccctgatccgctagatccgataattgctgttgattcgttacgattaatagttaggtttatttgttttaagattggttggccgtacttgtattcaaaagaaacattagaatattgaataaagtttagagtagactggtccttattctcagaatttctaatactctgattggtttgttgatctatcggtatgtgcaatatttgatttagccgcgaactggcagttcctgcatgttgaagattgttctgcagattaattattgattcaaaaggaccaatgaaatatcccattaacgaattaaatgctactaactgtccaactgtaatttgaccattaattgccatctttgctccggaataaagtacaagtaaactcaaaattaacccagttgtagactttaatgactcttgcaatataacggcaacattatattggtgatcagctcgcaaggtatttacaaactttttgtcaagggtttcatacattttgtcctcagcattcagcgattttatcgactccattccccttagatcttcaataagttgagaattaaggtctgaatttttctccattcgattgtaattatatttgtggaagggtttataaaagataagcataattataatataagcgggaatgccaattgcggataatataaaaagcctcatattaatacaagataagacaattccagtgatgataattacaccactgtccaaaattgtgataactactgttcgagataaagtcgaaataatcgtttcggcatctgaaaaccgtgatgtgatttcgccgatctttctttcttcaaaaaatgccattggtagtttgaataggtggcgaatatatttcaacaaaatttctagagatactcgctgcccaagaaccattgataagtactcttgagtgtaagtgaagaagccatggaaaatgtaggctagtaataatgagagtgcagtggcacataatacatcggcctgcccttttttaaccattgaatcaataatctgctttaaaaaaaatgccccactaattgttatcaatgttgataacatagttgctaagagtacggaagcgatgattcctttttgcctaaaaagtaattttgaagtcgacctaagatcgttagtatcttctttgattacggtgtatttatcagttggagtcatgtgaagtgaaatgcctgtccaatccttaccaaatgaattgtatgacatacgaacagtttttatagatgggtcaggatctgcaatggtgactgtggactttgacaatttacatactacgacataatgctgtccatattttttattaacgtgggcaataaaagggatcggaatatctggtatatttccttttaaaaatgatatgttcgtttttattgcctttggggctaaattaaaatgtgttgctgcgtgaattagacccagtgcagtggtaccatttttgtctgtttgtgcatatttacgaattgttgatattgatactcgtgacccataatacttcaatatcatcgccagagctgcagccccacagtctgtttcatctaattgactgacataataatgattccacatcatatttttcctccatgaatgccatgctcaaatttttaatcgacaattaaaaattaagtaagatattttctaatagacatattgtaacattattttggtgattttatataaaatattgtacctaataaataatattatacctaaaaatattgatgtggtatataatgtttataattagacaatggactctggaggactagttatgaatgtttcacagaaaatacaatattgcagaacactaagaaatcttacacaagatgaagtcggaaatttgttgcacgtatcgagaaagacaatttcaggctgggaaacaggaaggagttctccagatattctcagcttagtcaaactttgcaatctttttgacatttctcttgatgatttgctacgtgacgaacatatgattgatcgtgattaccatggatagggttatagttaatggccaacaacaagaaagcttcaccaacgagatagaaatgtcattcttgctatgtattttaaaaatttgtagattgctcctaggttgcacagaaactcgttaaatatcatctttacaaattactattgacattgtactaatggatgtctacaatatttattaaacaattagaaaacgctgtgagaaagttgagtagcgtcatgacaacctgaagcgagcttcgtttggtgagaggaagcaggaggattgacgcgaaaatcccttttgagcgatgtaccgaagaatgacagtaacgtgcattggtgacacccattatcgtgttagcgtatcgcttttttggccgtacgtgaaaggcagttgtagcgatataactgcaaatataaggtggtacagtgcagtaggcgcccttaattcagcattagctggatgaggggcgcctttttagttactcaaaatttggatcgttttctagtgaatctagataggaaaagagttggtgaaaatgaaatctcagattgatattagtcagattaggaatcaaattcaggacttaaataatttattcattaaaggagatcttcatttatgcaggaattacatgacttaaatccaaacccgttacggaaacgcgattatttcgtcgtcagctcaatgttatttggcctctttttcggggctgggaatttgattttcccaattcatttgggtcaattggctggggctcactggctgcttgcggcggttggcttcttagtgactgcggttttgctgccgctgttgtcggtactggcaatcagtgtcactcactctgaaggggtctatgacgttggtaagccgcttggtcccgtgtttgccttgacattcatggtattaattcacgcaaccatcggcccattatttggaaccccacggacagccacggtgccatttaccgtcggagtgcagccactgctgccgtcatcaatggcgcatgttggcctgttagtcttttccgccgtattctttggcttagcttttctggtttcttataaggaatctaacgtcatgacgtcagttggaaaagtgctcaatccagtctttttattgctattattcagtgtttttgcattaggatttgccaatccgatgggcgttgccggcaaacaagccgtcaccgctgcttacaagagtgattccttcttcaatggtttcctgcaagggtataacaccatggatgctctggctggcctggcatttggggttaccgtcgtcacggctgttcgccagttgggaaagaccaagcccagcagtaatgccaaggtgactgctaaagccggggtcttcgcaacgggggccattggcttgatctacctcgggttgatctggttgggtgccacgacactttcaacgtataaagcatctgccgacggtggtgtggccttcaaccaattggtaacttattacctgggtggtctgggtcatgctctgcttgccactttgttaaccgtcacttgtttaacgactgccgttggactggtggctgcctttgcacaagattttcataatcatttctctaaggtcagctatcgcggctggttaggctttatgtgtgtcgcatcgtttgcgactgcgaactttggcctcgatacgattatccagtggtcgacaccaatgctgatgttcttgtacccattcgcaatggttttgatcttgctgtccgtcttctcaccgttgttcaaccgtgatccactggtttatgcactggtcgttggcttcaccacggtcccagccttgctggacatggttgctgctttcccaccagtcgtgagtcaaagtgcctttggtcaggcgttgggtgctttccagcagcacgtattgccatttgctaatctggggatggattgggtggttcccgctgctgccggtgccgtcttgggacttggcctgcattttctccggccggttttgggcagagccaaagcaccttcatctgaagaaaataatgattaatacagtcacataatgttttaaccgataaaaaaatcgttgagccagccaccagtaatggccagctcaacgattttttgtgatttaacagctgattattgtaaattagtaaatgcgccgttttcttgaagcaatttcacaaatccaggaacggtatcttgacggttccaatcccgctgcagttcgcagactaattgtggaatcgtaatcaggtgagcgccggcttgttcaactcgacgcaaggcagtttcgtgcgcgatcgtggacgtgccgccgactgcgtcgacaactgggtagacatcaaagccttcagcgatggcatcgatggttgggaacgtgagacaagcttcagtccataaggctaaaataataatctttttccggccggttgccttgattgcatcattgtaatccttgtcttcccaagcattgatggaagaacggtcgtaggaaggggtgtcgcctatcaagtctttcagtggtttaacagtatctgaattgcgttgattatgggcattcactgtcgaaagcacaattggcagtttaaagagtttggctgcttccacaaccatttctgcattcttcagtaagtccgcatgccgcatcgaaccaattgaaccaatttgcactggttggtaatcaatgattgttaaaacggcattgtcaggtgatagtaagcggtcgtctgcgcctcgtttgtcaaaacttgtcatagtatcttcctcctcaaaattaaatccataagtcctctagaattcgctttcatgatacaacgatcagggagtcgatactactaattacaccttgacctcaaagccttgggaaaggattcaattgttgaaaaatttacattgaagactaacatggaaattggatgaaaaacgtagtaaataatttcaaagcggcgacaaatgaaatggttaaaaaagtttttttagcaatggtgacaatcttagtttcagttctaatgcttgggtcggtcaattctcaggccagttccaaagtgaataactacatagcaagtcacaatatttctcacaatcaagtctcaagcaagatttggggcggttttccacattataaataccgtcacggtaaaaataagcctgagggcgtggtcgttcatgaaaccgggaactcccactccacgatttttggcgaaattgcgtacatgaagaagaattaccgaaacgcctttgtccacacttttgtcgatgacgaccacattattaacattgccagcaccaagtatctctgctggggcgtcggctatcccggcaatgcccgctttgttcaatttgaacaggtcgaaatgcacagtaagaaatcattcgccggtgaggtggaaaacgctgcttactatacggcctatattttgcacaaatatcaccttaagcccaatgacgcggtatacgacggccacggcaccgtctggtctcatggtgctgttgcccattatcttggcgggtctgaccataccgatccaaagggatattatgccaatcgcggcaaaaaatacttccaccaatcttataccatggcacaattttatcagctggtgttgaccaactatcacaacctttaatttggtgaaatatcaaaaaaacctttacaggtggaatcttttagattattatcaaaagagtaatcgttactatttgcaagggagaggatatctcatgttacataaattttcgggcttcaaggcctggctgttagtcgtagtggcagttgctttaggcattggcctaaccggttgtgcaagcaactcagccagcaatggcaaaatcaagattaccgctacgactgatttctatggcgaggtcgcaaaggcggttgtcggcagtaaaggggacgtgacttccatcattaccaaccccaacgtggatcctcacgattatcaggcatccacaaaggtggccaaggaaacggttggctcaaagattgtcattgccaacgggattggctacgatggctggatgaataatctggttaaggacagcagcaaggttgactatatcaaagtcggtgaagatttgatgggtaagcagaacggcgacaatccacatttgtggtataatccggcaaccatgcctaagttagccaatactattgcgacaaagcttggtaaactgcagcccaagaacaaggcctactttaagaagaacgctaagaagtacatcgcttcattgaagccggtcaatgataaaattgcccagctgaagcaactcgccgcaacaaagaagaacaaagaagtctacgtcagtgagccggtatttgactacgcccttgaagcaaccggctttaaggttggcgacacccagttcgaaaatgacactgaaaaaggcgtcgatccatcaccgcagacaattcgaacgatgcaaaacggcatcaagaaccacaagatcgccttcttcgttttcaacaagcaggttgacagcaagactgtcaataatctggtggccttagcaaagcagaacaaggtcccggtattaccagtaacggaaacattgccagctcataagacttacgtcagttggatggattcacaatatacccagttacttaatattttgaaatagttcgtatcaaaaaagccgagaagtcagaattgatttctcggcatttttgtatttaattttaaatttttcgatcagcgattagttcaaatagccacgccaaatccagccgccatgattgccgacggtactgcgaacgtgatagtaaattgcatagttaccggtgtttttcttgtacaacttttcatgcgcatcggttacccaagtcacgttggggagttctgagttgtagccataccgggtgccaaggtgcttggagtatctggcacccttggtggttgtgtagtagtgcttgcccatattggcgcgccaaactaatttgacggatgccgaacgagctgccgaatactgcttaccggatgggccaggaatcttgacgatttccccatcatttttagaactggaaccagagttgcttggttttgtcgcactgctggaacttgattcactggaagcactcgaggcactgcttgagttagcgttggtgttggtagaagctgccgctgaaccggagttcaagtagaagctgttatttaactggctaacatccaaattctggttgatatttgggaaccggtagtcggaagcccattgccaggcattggctgaagggtacttcgacccggttggggttgccggatagtcggcaatccagccctggttggaggcgttggtgtcaatctttacgcccaaccaacttgccatggtatataaatcggtcttgttatagccgccctgattcaaagctgaatcaaaagctgccaaattggcatcgttattcgctttggaaattccacctaattctgaagattcaaagtcagctaccatcacgacatctttcgaactggtaactgattgaacggcattcatgaagttttgggcttcctgagcggcttgatcagtcgtcgtaaagtgaacaaaatgatagaaattaatacttaaccctgcctgctgggcatactgcacctgttgagaaagatacggattgatatatccggttccctcagatgctttaatcgtgaccgctttaaccccattttgagctaatgtttgataatcagcggcagttaaatttccctgccaactggaaacatcaaccatgttggcgccaggttgggtactggacggcgtcaaagccgcgtgggcagtggcgttcgtcccaaataaaattcccccggcgaagagccctaagataacggcccctcttttgaaacttttcctcataatcactcaactcccatctatgtatatacacatcactgtgatactaacatgaatgagggcctttcggaagaatgtttacttattgtttccacttcgtcgatcaagtgaaaagctccagtaaattgcgagtaacaaaatggctgcgattgaaatagttgtaatattattggccatcgcatgggtgctgacctgccaggcaacgtaaattaacgcgagttggaaaacccacgataggatggactggccggcaaactttttggtaaaaaatttcattagataattcctcctattattctggaatgtcaccattctcagggatgtaatcaattgaatcggcaattcgcttgggaattggaatctgtggatcaacgtggggattgttaaggtgaatcaggttgtaggacttgcgatactcagtcggcgataacccggtggcactcttgaaacgccgcatgaagacctttggatcgttgaagtaagagttgtcggcgatttgcttgatcgacatatcggttcgaatcagcagcagtgtcgccacttcaattttgacgtgattcaagtactgcaaggttgtcatgccggtgcagtgtttgaacagcctggtcaaataatctggattcagatgactgcggtcggcaatctctgcgacggttaaatcactggacatgttagcccgaatccattctttgagactgttaatccgcgagctgtcttcattggcatcgggacgattgaagtatgacttgtacagctgaattaaaagtgcagaaaccagatagtcccgttcttcgataaatgataattcattgtggattgatagaatctgatgaatcagaatggttgcctcttcataatcggctaatttgaaatactgcggcagaaaaatttgccgcttcttgctggtactggctttaactttttcagtcatgtcgtcttcatcggcagtgagcgtatcttctttgtgctgggagaaaaagtgaacccagtagaagtcgacgtcacctggggaatcttgataaccataaaaagtggtaaacggcgggacaatcaagacttcgtgggtgttgagggtataccgccgatcgccaatctgtagataaatcggtcccttaatacataggattaattcataatcacccttatgatacatgcgtcgatggtgccagcctttatgagctaaaaattcaccacctttatagtagagtagcgttttttccattgtgaacgttgagaataacatttcaagccaacctcctaacggtgtcggaaatcgtcaccaaatgtacgcaaaaatagttttacggcaatgtcggaaacagtcaccaaatgtacaaaacagtgtcactattggcctcgtgacgctatcacggaacccaatattttctcaactggtcggatatcatcacttcttttgccattatagacctttttttattatttggaaacgcttactataagacttgtaaaaacaagttatgttttgaacattgatttttcagaaaggaagttgaggccaatggttcaaattgacgatcgactaagaagctcaccagtttcttaatcgggttagtttcagtgtttcagcaatcatttttatccgcccaacaatgagcgggttaccaaaattaatttatttggaggaattatcatgagctcaaatgcaaacgtagattcaaatacggcaagtgctcaagcattgcttaacgacacgttaccttggcacagaaagattacctatggttttactgatatgtctggtaacttactgtactgtattatcagttcttacatgctttacttcttcaccaacgtcttcggtctctctgttggaacggccggtgttttacttctgatcggccgtgtctttgatgccattggtgctcctgtcatgggtatcttggttgaccacacccacagtaaatatggtaagagtcgtccttggttcttgtggatgtcattgccatttgccatctttgtctggttaccgtttaccaccccagcattgagcggcactttaaaagttgtttacgccggtgttatgtacatcttagccgacttatcatacaccgcaatgtccacaccaatcacttcggttttgcctaacttaacttcaagtaccgacggccggatgcaagccaactcaattcgtttggttcttggtaacgttggtaacttcttcgccgttactttcatcattccattcgctggtttactcggcggtgggaacgagcaaaaaggttggtcattagctgttggtgtttactcaatcgttgccttccttctcttaatcatcgccttctttgatatgcgtgaaaagaatatcgaaaacgaaaaagtgattaccattaaagaaagtttgaaagccactaaaggcaactggccttgggtcttgattgttgttgccaacttggcttactggactgcatttatcgttcgtaacgcttcaatgccttactacttccagtacaacatgggcagcaagggtctgatttcattcttcaacggtttcacaattatccaagttatcggaatggcttcagttccattcttcgttaaatttatgcacaagtggggcaccacaatcttcttcctgctgatgaccatggttggtcaagcatgggttggtttagctggttcaaacgtcacttccgctctgatcggctggtgtgtcgcatgtatcggttcaggtagtgcctgcacaatgttcttcgccatggtcggtgataccgttgactttggtgaatggaagactggtatccgtgccaacggattcttaactgccatcggtgcttcattctgtatccaaatgggttcaggatttggttcattcattgcttcaatgcttctcaaaggtttcggtttcaacgctgccaatgcaactcaatcaagcgcaagtcttggtggaatcagctttaccttcgtctgggttccaattatcatttacgcaatcagtgttatcttgatgattatgtatcgtaaatgggaaaaccacgaaccagttgttaaggctgaccttgcaaagcggaacgccgaagctgaaaagaacgctgaagctgcacaagcttaattgtgagattgattttaaactttaggaggaacgcatagtatgcaagtttataccacaccaaaattaaataaggtcaaggttacttcagatttctggaaacgctaccgtgaactcgtcgtcaaagaagtcctgccatatcaatggaaggttatgaacgacgaagccgacatttctatttctgaagatccccaaaacaatggccaagacaagaacagtcatgcgattgccaacttgaagatcgctgccggtcaaatgaaaggccaccactatggctttccattccaagacaccgatgtctacaagtggttggaagcggccgcatactcattcgggtatcatccaaatccagacctcaagaagattaccgataatctgattgatttgatcgctgacgcccaagatgacgacggctatctgtcaacctacttccaaatcgacgccccagaacgtaaattcaagcgactccaacagtcacacgaactttacacgatgggtcactacatcgaagcaggagttgcctatcatcatgagactggcaatgaaaaagctttggacattgctaaacggatggctgactgcatcgaccgcaactttggccttgaagaaggcaagattcccggctacgatggtcaccctgaaatcgaattagcactgtcacgtttatatgaagaaaccggtgaaaaacgttaccttgacttggcccactacttcttgaaccaacggggccaagatccggcattctttgaaaagcagattcaagctgatggcgacagtcctgaccgcgacctcatcccagggatgcgtgatttcacccgtgagtactacttggccgcagaaccgatcaaggatcaaaaagttcctcatggccacgctgttcgagttgtctacctgtgcaccggaatggcttacgttgcccgctacactggcgacaaagatttgttagctgcctgtgatcgcttctggaacgacattgttaaacgtcagatgtatatcactggtaatattggtcaaaccacgactggtgaagcttttacctacgactatgacctgcccaatgatactgattacggcgagacttgtgcttcagttgggatgtccttctttgcccgtcaaatgctgaacatccacgccaaaggtgaatacgccgacgtgctggaaaaggaactgttcaacggtgccttaagcggcatggcacttgatggcaagcacttcttctatgtcaacccattggaagcagatccagttgcttcaaagggtaatccaggtaagtcccatgttttgactcaccgggctgattggttcggttgcgcctgctgtcctgccaatcttgcacgtttgatcgcctcagttgatgagtatctctacactgtgaatggtgatacgatcttgtcacatcagtttatctctaacgatgctgaatttgatgacggtctgaagatttcgcaaacgaaccacttcccatggagcggcgacattcattatgaaatcgccaacccagacgccaaatcattcaagctgggcattcggattcctagctggtccgctaacttcgacttgactgttgacggtaagtcaaccaccttgcctgttgaagatggcttcatctacatcgatgttgatgccaagtcgttaaccattgatttgaagctcgatatggacgtcaagatcatgcgcgccagcaacagagtcagtgctgactttggcaaggttgccgttcaacgtggaccaatcgtttatgcagctgaagaagccgacaaccaagcaccactggcttcatatgaagttgcaacagacgctaataccgactaccacttcgatgagaaattgttagatggtgtcggagttgtcaaagttgctgctcaacgacaaaagttggattccaaggatgcacctttgtatgttgacgccagtcagccggttgagtcagaatcagttgacctgaagatggtgccatactacgcatgggctaaccgtgagaatggtcaaatgagagtttggttaaataaataaatcatttaaagttagcgttttcaacctctttcataattggttaaaatgctgtatagtatgacgagatcctgatgttatttctgacataacatcacaacgaaccccattcgtataaggatcgagcccctccaagcaatcctgcttggaggggctttttgtgtattggcaggtaagacagctggcattttgaggttgaataatgaccttttttggctggaatccggggcattttcaaaagattttcattcttaacgcttacatcatgaaaatgtttcaaaaatctatatactgaattttcataatggcctataataaattcgaaagcagcaaggttggcttgctgtcgggggttcgagtgcttaggaggctattaaaatatgaacaaaaaatctggaatgatgtcgttttcgattctgatgctgtcattattaccaatgtcaacgggggcgacggcttccacaattcccggattaatgaaacaatttccagcggtttcatcggaaacggccgagctgactgtcaccatcccatcattcacgatggccgtagtgattatcctcagcagcttgattgtcaaacgaattggcaccaaaaaattagttctggcaggaactgcattaaccgcatttggagcaggactttcaatgttttcaccaagcgttgcagtcttgttgattgccagagcgattatgggagctggaattggagcttttaacaccctttgtatcagtttgattgatcgcctgtacagcggtcagcagcgtgaacggatgctgggttttcagaacacttttcaaggtttgggggctgccggcggtgcactgggagttggtctgatattgatgtacagtaactggcggatggcgtttggaatttatttgatcagcgtcgtcttgtttgtactgtatcttttctacgtacctgaagttcgttatgataacgatgatccccaaactgtcggtcaagctgacgagaaagtctcttggatgtccaagttgcagtttggttattattggatcgtcatgttcatcttgatggtgttctacatgactgttaatgtgaaaatgccaacctacattttgaataatcatttcggcgccttgtcagttggatccacggcggtcgttgtgatgtcgatcggcacgattattggcggcctgatttatggctttattgaatcgattgccaaaaacgccactttggtcatggcgattgccattgaagccgtgggtgtcttcatgatcagtacggccggctcggcgttggcctgcttcatcggggcttttaccgttggttttagctttggtctgtttattccgttcattttttccaaaggactgtcgtttgttcccaaaaaatatggcaatgacgcgacgactattttgatgatcagtaccaatggcgccaacttcctttgcccatacgtcagcaagttcatcaacatcggcggtactgaccgcagtttgtttatgatgtccggcgtgattgcctcaattctgggaatcatcgagttggtcaaattattagccaatcggccgcgaagaactgttcccgaagcttaatgtttttgtgaattttactaatctaaatgtatttctgaacctctgtatgatattattcatacagaggttctttctatattatgagccatgctgagtgttacacttgagatggctttaatacaaggatcgagtgttaaaaaatcaattcggaatatgagtgtaatgggtgataagatgacaacaattaaagatgtcgctaacgaagcgggtgtttcgatatcgacagtttcacgaattttgaacttcgacgatacgctttctgtgggggaagacacgcgtagaagagtgttggaagttgctgaaaagctgcaatacaagaagcggaatcggcatgtaccaaaaggcggtaaaaagattggtattattcaatggcattctgataaagaagagctgactgatctttactacctgcaaattcaatacggcattgagaacaaggcggccagcttaggtgccggcgttgagaagttgacgtttgattcgatcgataagagtcgggtgaagggcctcagcggaatgattgccgttggtaagtttgataagaccgaagtcatgagtttgaaatcatatgatatcccactggtctttatcggtgagaactatttagcttacgattgtgatagtatccgtagtgatttcgagtcaccggttcgtaagattattgatcggtttattgagtacggtatcaaggatatcgggatgattgccggtaaggaaacgaccgtgactgaaaagcagggcgttcgcgatcctcgagtgtcaacatttgattcgtatttgtcagaaaagggtttgttcaatgatgccttcgttttccaaggaccatttggcccggattcagggtttgagctgatgaacactgcaatcaaacagttgggcgacaagctgccccatggattcttgattggcagtgattcaatggccgttggtgtcttgcgagccctccagcagcagaatatcagcgtcccggatcgggtcagcttaatcagctttaacgatgttgcaattgccaagtataccagcccggcattgacgacggtccacgttcacaccgaattgatgggtgagcgggcaattgaaatgctgacggaccggattaaagaaccgaagaaggtcccagagctgacggtgattgcgacggaattgatggagagggagagcagtttataaaatcagagtggagcaagaggcgctttgatcccagaatgtaaggtaattaagtgattattcccggttttggaatgattgcttaattgccttacatggcggggatcagccgattgttgcacgtttcggcaaagtaaaagtggtgctaatgcaagagtggagcaagaggcgttttgatcccagaatttaaggcgattaagcgattattccggggcttggaatgattggtttgccggcttaaatggccgggatcagccgattgatgcatgtttcagcaaggtaaaagtggtgctcacacaaaataacaggcagggtcaaaagcgaataacttttgcccagcctgtttttttagtaaatttaaagattaacatctgttataacgtagaatccaagtcatcaaaggaaaaagcaagcctcattctctaggatgtttttctcaatagcgacggggattctcgtcccctttagaatagttttactaaaatctattgactatacccgataatatagtaaaattaaagcaacagcacaaaagaaagcgcttgcgaaagtgataaacaattaccacttttaaaccctaggaggatgaaacgatggaaaaaggtttactttatccagttaccaatcaatttagacaagatcaaaagttagacggcttatgggattttaagtttgacccacaagctcaaggtgaggccaagggatggacaaccggttttgacgatccaattaagatgccggtcccagccagctttaatgatttctttaccgacaaagattcccgtgagtataccggggatttctggtacgccaagaagttcttcgtaccaacctacatggatggccagaccattcagttgcgttttggagcagcaacccaccgagcaaccgtttatgtaaatggccaagaaattcgctcacacgaaggcggctttctgcctttcactgcagatattaccgatgcagtgaaattaggtcaagaaaatattgtgactttgaagatgaacaatgaacttcatcgagatgcattgccagcaggtgatacagccactttgaagaacggcaagaagatggctaagcctttctttgatttctataactattcgggcttaaaccggagtgttcatttattagccgttccgaagaaccatatttatgattactcaacaacctatgatgtcagtgaggatcaggcaaccgttcattatagtgtccaagcaactgacggcagcaatttcaaagtcagcctgagcgatgaggatggcaaggtggtcgcaaccgctgaaggacagactggtgatttggtggttaagaatccgacattatggcaggttcgcgacgcctatttgtacaccatcaaatttgagttattggatgctggcaaggctggtgatgaatacagtgatgaaattggtttgcgaaccatcgaaatcaaaggtcacgaaatcttagtcaaccacaaatctgtctacctgcgcggctttggtcgtcacgaagacagcatttatgccggtcgggcatttgatttgaacgttgaacgacgtgatatgaatctgatgaaatggattggagccaactcatttagaagttcgcactatccatacgatgaacaggtctataaatttgccgatcgcgaaggcattctgattaccgatgaagtgcctgctgttgggttcaagatggctgcagccagtttcctcggcggtttaaaccaatcattctttgacggtgactggattgatgaattgtacaagaagcatattgatcaggttaaggacatgatcaagcgtgataagaaccatccaagtgtcctggcatggagcttatgcaacgaaccggatacttcaactgactcggcggtgccatactttaccaagttgtttaatgattcaaaggatttggatcctgaacaacgaccaagaacctttacccttaacgaggacgacacctttgaaaaatccaagtgtttgaaattccctgacttctacctcctgaaccgttatccaggctggtaccacaagtggggatacgaaatctctgatggtgaagctggtttgcgggctgaattggatgaatggaagaattctgacatcgataggccgattgtcttctcagaatatggtgccgatactgaaccaggactgcacaagttgccatcgattatgtggagcgaggagtatcaaatcgaattgctggatatgttcgatcgggtatttgactcctacgactttatccggggtgaacaaccttggaacctggccgacttccagaccgtggaaggcaacatgcgggttaacggtaacaagaaggggatctttacccgggatcgtcaaccaaaagccgcagccttttatttgaagaagcgttggacttcattaccactggattataaagcaggtaaatagcattgcaggagaggtcggaacaatacttaacgagtactggtgttccggcctcgttgtataaaagcaaatagggtgactgaaaaggagtgttaacatgaaccagacaagttttgtcattgacggggagcaactggatctaaatgccaaagatgccaatacatttaaaggctttggctacttgagctgtaacaattcttcccgactgctgctggattataaatgggaacatcgagacagttatgatcagattttgcagattctctttggtggtaagcatccattaatgcggatgttaaaagttgaaatgggcgatgatgccaacacgtcttctggaactgaaccggcaacgatgcgctctgcctcggaaaccgcaaacgttaaccgtggggctggtttccagttgatcgccgacgctaagaaaatccaaccgaacttaaaaacggccattctgcgctggggtgagcctggttggctgagaaaagattggttcaacgccaagtcggctgatccggatggtaaagtgccggcaactgcctatgagccgatgtatcagtggtataaacagacgatcatctcggcttatcagacatatggttttctgatcgattatattgatcctgaccggaacgaaaccaagcatccgatggttaaatggatcaaatggtttgcggatcgcttggaaaacgatcagtctgagtttccgaatgactttccgattagtcggtaccagcaaatcaaaattattgctgccgatcagaactatgaacgtgattttggcgatatgatgattgctgatccggacttgcgtgaacgagtcgaagcacttggctttcactacaacaccgatgatggcgaaaaacagccgtttacaaagttagcagacgattaccatcatgaagtttggtacagtgaaggaattgcgccgatgacgatgggtaagtaccgagttcgcgccagcaatggtgacggaatcggcggccgtcaaagcggcttggatgttgctaaccgactgattaagagctacgtgaaatctcgtcgaagtttgtatattttccaaccggcagtttccgcttattataccggggtcaattacagtcacaaagagctgatcaatgcctgccgaccgtggtcaggttactacgaagtcgataatgtcgggctgcagtgcatgaagcactttactgattttgccaaagccggttgggaagacgaaggtgcttggcggtacttaaccagtgcctgcgacagtcaagtcggcggaactgaaaacctggatcataatcggcaggccccaagttacatgactttgatggcaccagacaaggccaactactctgtgatttttgataatgacagtcctgaagcgcgcacctaccagattctgctgaaaaatcttccggcttgtgaagacaaaccggttgccgtttggcaaagcgttggtcccgagcatactggagatgcatatgacagtcggatgaagcagttacgagaaaccgtttcgccaacggacggtttgctcaaaattattgttgcaccccattcgattgcgaccgccaccacattggatttggctgacgatccggaagtggtctatcatcgcttggagagcccccatgaagaccacacccttggtatcaaatctgatgatggcgttttgtatgaagatgattttagttgctcgggctacccagaaaattatttatcttctcgagggaatacgccacggttcactgctgatcaaggtggcgcctttgaagtggtccagaccgacgaaggcaacgtcatgcagcagatgattaccgataagcagcgggctcttgactgggaatattcatttgctcccaacttaacattcggcgacgaccactggacggattacgaggttgccgtgtcaatgaaatttgacgatcaaactcagcagaattcgccaaccggaaactactttgggatcggtttgcgggaaatgaccgacgtcaagggtcgccttgagagtgccccgtatgtctttaaagtagccattgatggtggatgtgagttgattaaggatgaccaaattattgccgtggaacacattgacggcttggatgtttcggcaacgcatcaagtcacgtttgcagcggaaggtaatcatttaactgcgacatttgatgggcagcgggttttcgattataccgacaccgacaatccacattacagtggccgcgtcaagcttgggagcgggtattaccatacccagattcagcagttaacagttacccagggcaaacagccacatttgattgaacacagggtagatgatctcgattcagctgttcaatatacaggcaaatgggatcatgtttgcggtttgggcaataccaaatggaatcgaacactgtcgatggcaagtgccgaccaagataatgtgccaggctttgaatttgacttcaacggatctggattctcactgattggggctcaagatgctggcagtcgtctgaaggtgacggtggatggagccgttcgcaattggaatctggcaccacaagttggtgctgatcggacagagaatatcgttgttcatgggttgtctgccggtaaacatcatgtcgccatccaagttgttggtggtcgttacacactagatgcggtggatttcttaaaataatccagaaaaaagcgaactgaaatttcagttcgctttttgtatcccttaatattgacgaattttaggtggtgtgtagttcgtcatgaacgtataaatttcatccagtgaatcggagaacagcaccttcttgcggtcagctgccgataagaaaccttcgctggtcatcttatcaaacattttggccaacaggtcatagtaaccattcacgttataaaacacgcaggggttgggattatcccccagccgagcccacgagaaggcctgggtgatttcttcaagcgttccgatgccgccgggaagggcgatacagccattggagatgttcatcatctcagctttgcgggcagacatgttgtcggttaccgtcaaatctgataattctcttaaacgcggtgactcagctcctcgagcaactaactgcttggtggtgacaccgtgaattttcccgccttcagccaatacttgatcggacaacacgcccatcaacccgacgccaccaccgccgtaaatcaattcaagatcgtggctgactaaccaagatgccagttttttagtggcggtgacgtatacgggattcgtgccggttgcggccccgcagtacacagctatccttttcatatccagtctcctttgaaaatagtctagtcttattctaccagtttttctgaaaacaatttttgaaaatcgacataggggactataattaaattaccatttcacgaaataatttaaggaggttaccatggaaacctatattttagatgattcagacgacatgtggcagcattttgccaaactgattggcaacgtttcttggccggcaggcaaatatttggccaatgaaatgctcggcggacgggtgtctgattgggaacgggttatcgttctaatggatgacgaccagttagtgggcttttgtgcggtcgttcgggaagatatcgttaaaggaaccggctattcaccattcattggctttgtctttgtcagcgaggattaccgcggcagacatctcagccaacagttggtcaaattggccgagaaccaaatcaaacaaattgggtttcataaggcatacattgtcaccaaacacgttggactgtacgaaaaattggggtacgaacaaatcgatacttccgtcgaccagttgggaagaaagatgaggattctagcaaagcaattataatttgattgaggagagaaagaactaatgaacgaagagaccacagtaccaagccgccagaaagtcattttgggtgctctgctgatatttttagtgggtgccaatatgcggacggcgattacgattgtgccaccaattttgaccaatattcaaaactcctttcagatgccggaatggtttctggggagcttaacgacaattcctttgatctgctttggattattatcaccgacggttacatattttattaagcgcttcgggattttgccggtaacgatggtggatctgggcttgctgacaatcggcaacttcatccgggtttattcctttaccagcttactgttcgggacaatcttgattggttgtgggattgcgatgttgaatgtcctcgcaccaactttggtttcctatttgtttccgatgcagatcgggacttataccgggatgtatgttttcgcgttgtcactatcgagttcgatttctgccggctttagcgccgtagtcagtcacttgatcacttggcaggtgatgattcaattcatttcgattattccagttatcacaattatcgtggcgatcatgttgagaacttcaggcaaacgcaagacctcagtcaaaaagacggcgacaccacttaatccagaggtcaaagtgagcgtttggaagcggccgcttgcctgggcattgggtggcttcatgggtttgcagtcacttcttttttactcaattctaacctggctgccaccaatcctgatggcatcagggattaatcagaatacggcaggatacttgttggggctgctccagttagtggcactgccgatttcctttgtcgttccaagaattatcagctcggttgccaaacagtcaacgatgatttggacgatctctggtttgtttatcgtcggattgggatcattaatgatggctgaaaccagtttctggtttgcggtccttgcttgtgtccttttgggattgtcaaccaatatggcgttcagcgaggcaatgaccttgttctcgctgaagacaagaacccccaacgaaacagcctcagtctctggaatgggtcaatcatttggttacctattggcagcgacaggcccgatgatttgcggctggatgcatggcctgaccacaaactggtttgcggttttgattttcctactggctgtgaccgttgtcatgacttttgtggggttgttggttgatcgtgaggagtatgtgttttaaaaatcagtgtgggcaaataagcgcctagcttccagagtataagagagttcgccaaatatccagggcttggatatttggcgaactctcttatacggccggaaactgcttatttgcccacgattccactaggtaatagtaaaaaggcacaaagtaaacaccaaaattacattccacaaacgcctcattaaaaataaattaaaaaatgagttgactctcagaaaaaatctgttacgataatcactaatatatttaacgaggatcgaatgagtaatcagtggagttagccaagagagctgtcacgtcggtgaaagacagcctaacgagattgatgaatatggttcgtgagttgcagtagccgagcacttgtaaggctacgatgttgggcacattatcgtctacagtttgaaaactgactgagaaagcatgcgtgagtgtgctttgaaatagggtggtaccgcgatacgttcgcccctatggcagctttaacaattgaccggtttgttaacgcaaaccggttttatttttcgaaattttgaggaggcggatactgatgaagaagatagtcgtttcagtagtgggattggtgagtgttttggtgttaagcgcctgtggcaagtcaacgtccagtaaggatgcgaccagccggacctttcgaacgacagcccagacaaatgtcatcactgtcgatcctaatcgggcaactgatgttgggagttatttggcaatttcgcaagttgtcgagggcctgtataaacaaaataatcaaggaaagattgtaccgtcggtggcgaccaaaattgttcagccaactaatggcgggaaaacctacacctttaacttgcggcacgatgccaaatggaacgatggcagtcgggtcactgccggcgactttgtggcctcgttcagacgacaagttgaccccaagaccaagtctcaacgtgccggtcatttgagcgatattcagaattatgatgcggttaattctggcaaagcggcgccatccaaattaggtgttaaggccattagcaagtataaactgcagctcaagttgagccacccggttccgtattacaactacgtgatcgctacccagttgtatccgattaatcagcgggcgctcgccaaatgggggagtaaatacggtcaggattcaaagcacgcggcttccgacggtgcttatgaaattaagaactggaattcttccaaagatacctggaacttggtcaagaacaaagactactacgatgcgaataaagtcgacttaaccagaattcatttccaagttgtgaaaacaccacaaaccagcatgcggttatttcaggcaaaagacatcgatgagacccaaatttcgggcagtttggttgctgatgccaagaaacaatttaagaatgaaacggtggtttcaaaatatggtcagttagcctttatcccttggaacaattaccgtaagacgacgcggaatctcaatttgcggcgggcactaagctacgctattaatcgacaatccttggcaaagaacgtcttaaaggacggatcactgccggcccaatcagtggttccggagggtgaagttaaagatgccagtggcaaagatttcaatgccggggttgccccaaagttgacgtataatctcactaaagcccgccactacttcaaattagcccaagaagagttgggaaaagaaaccatcaatgttcaattgttaaccgcggacaccgatgcctataaagccgtcgccgaatatattcaatcacaggccaaaaaagtatcgcccaactttaatttgaccgtgcgctcaattccattgcagcaagagatttccgacttcagtaatcacaagtttgacgccggcacgctcgggtggtcgacagacttcccagatccaattgattatctgaacttggctgccaaagccggggtcatcaactttaccaagtggacgaacgataagtatcaaaaactgattgatcagattaatgacacaacgcaccaaactgctgggcaacgagtgaaactgcagcagcaggccgcctcgttgttaaacgaacttcaaggcgtcacgccactgtaccagtacgcttcggttcatttgcgaaccaagaatattaaaggcttggattatccattaattggttatcagaagtatgagtatgcaagctggaagaagtagtagaggagatttgattttatgacgattaaaattggcattgccagtaatcatttgattcatccaactgaacgattcggaacaaattttgtcgattatattcaacgagactatgtcactgggctgagacatgctgggatgttgccgttagtcctgcccttgggcgatccgaaagacgctgaagattatattgctggagttgacgggctgctgttgtctggcggccagggggtgacgccaattttgtatggcgaagagcccttggcggaagttgctgaaacggatatttaccgggatcaatttgaaattgccttgattaaagctgctcagaaagctgacaaaccggtgctggggatctgccgtggcatgcaggtgattaacgtcgcgttaggcggcaatctgtaccaggacatctataaacaagccggggcaacggagaaacacaatcagtatccaacatcttgggagattcctactcaccatgtgacaaccaccgaggactcatggcttcaccaaatcttgggtgagcggtttgcggttaattcctttcaccatcaagggattcatgaaccgggtaatggcttgaaagtcgttgccaaaagtgatgatcaggtcgttgaagggatcgaatcaaacaatggtcgaattatcggcgttgaatttcatccggagatgatgcgggcagttcatccggaattccagcggatttttgattattttgctaaattggcaacagagaattaatataaatgtcaaaggctgaagcccagtgattgtactggtgcttcagcctttttttcgcctacttaacaatgatagagttgatgatgttacggcacctctgagcgccacttctatctagaccaaacgtgcagcaatcggctgatcccggccatgtaaggcacttaagcaatcattccaagcccggaatcaatgcttaagtgccttacattctgggatcaaaacgcctctttctccaatctatgcttaaatctccgctgccggattcgtcgtatacgttgcccacgcctgaacagcgactgtgcccaggattaggacggcgccgatggtttccggtacgccaaagctgacgccaagaaaaatgatcgaaagtgtggttgctgatagcggttcgaatgaccccaatacgctggcagtcgtcggttgaatgtatcgcaggctttgaaggtaaaataggtatgcaaacatcgtgccgaagatcaccacaaaggagacgctgccgtatgttgtccaagaaaaggccggcatgtcgtcccagatccggtaataaagactaaaggcggttccaccgattagcattgaccaaccaacgatgggaatcgagccgtattctttcaggaggtttcgtggtaataaggtatagagggtggaactaaccgctgcccccacaccccacacaaagccccctaacggcattgccaatgtggtcagttgaccatgagtcacgagaagaactgtccccgacaaagccataatgaccgagaagacgtcgattcgccggggaaagcgccgggtccacagagctaaataaataataatcattgctggtgccaagaactgaaggatggtggcggtggcggcattaccagcctcaatcgccatgaaatatgtatattgtgaagcagccattccaataaagctaaagaagattaagcttagtgagtcccttttgtggtgccaaacccgcatttcttgtcgatgattgccaatcaaaccatacaggaccaacagaatacccgaaatcagcattcggacagaaaccagccagtgtgagcttacatggatatcgtcaaataaaaattgggcaagtgttcccgagattccccatagtaaaggtcccagcattgccaacacaatgccgcggatacttccattcttcacctgattcacctcccatacataatgaaccaattatattacaaagataaccgatttagaataaccctttgtaaaataaagtgaattgcgttagagtatcattaatatttaatgatagaacaatacataagaggaggcctgcacatgtttgataaaattggccagattattttcaacaacgaaattgtcgcgaatgccagcgactttaatatgggcattgaggtcgaaacgattcggattgattcggctggaagattaaccaaggaaccgtaccccaaagcccttggcaatcaacgaaagaaccatttcatcaaaacagatgtttaccagattcaaagtgagattatcacaccgactgcccgcaagtccttggatgcgatgcattatttgatggcacttaatgatacgctgtgaaatgctttggagcctaacgaattattatggccgctgagcatgccgcccgtgttgccccaagacaaaagcacgattccaatcgctgatgttgaccccgaacagaaggcctactacgaaaaatggatcaaaacccgtagcgatacccaagggattcctgtcggggtccatttgaacgtcagcattaatgacgacgtgctcaaaacggtttggcaggcggttgacgatcagtatgattcatacgctgattttgtaaattatatttatatcaagatcgcccaaggctttgactactaccggtggttaatcacttatttgtttggtaatagtccaatcgctgaaaagaatttcttcaaacccgatgaggaccagccgcagcatgaagtgcgcagtattcgttcatcgaactatggattgacgtctgatgtgacccacaattatcgcagtgtgccggattacgtcaagaatatcgagtcaaatattgccagcggcgccttgttcagtgaagccgaataccattcaagcgttcgtctgaaaaccatgcatggcgacctaactgacatgatcaaaaacgggaccgaatacattgagttacgaatgctggatcttgacccgacgaccgccttgggtgtgcggacatccgccatccgctttttcagaatcctgctaagttatttcatgatgatgccgactcttgaaagcgatgagaagattaacctcaagttggaacaggggcgggcaatgaacgaagtggttgcccttgaaagcccatcccaacagacaatttatcatcatgaggcgcaaactttcttggatcaactccaattgtttggggcccagattcagtggggccctgaataccaggaagtcttggatacgatgcaggatcgactcgacaacccgaacctgacgccggctgcaacgctgtgcgatcatgaggttgacggctcactgatgtcatacggtctggcaatggccaaccgttatcaaaatcgcgcccatgagaatcctaatccatttaccggctttgaggaacagcccgatatgacggccaacgaactcaggcagcgtctgtttggtgtcatggggaaaccggaaaattataagaacggctgattcgttgacatgcggctgacgaatcactaaaatacttgataattaattgaagcctctaccaggtttagacgaagcgaagctgtgatgtcctacaagttttttcttgtaggatatttttgaaaataaaggatggtgggcaaatgaaacaagcaaaagaagtttctgatttcattaattcgacggttgggttggaggtggaaacccaccggataaataaaagcggtcagttgagtcacaaatcatatcctaaaggcctgctaaatgagcgtcagcaccattttatcaagaatgactttttggaaacgcagtctgaattgattaccccgccaaccaaaaccaccttgaaggggttgaaatacctgggcgtgtatcatcaggcactgcgaagtgagttggctggtaaagagtacctctggccatacagcatgccgccgaaattaaaagcggaccattctgatattgtgattgcccaaaccgaccccaagagctatgagtaccgccaacaggtggccaagatccgaaaaattgaacgaactgccgagaccggagttcacgtcaatatcgggttgacgaagaaggccatcaaggacttaactgctcaggaggccaatgtgagcaccgatgatctgtatctccaggcagtggttggctttatgcgctaccgctggctgttgacgtacctgtttggcgcaacaccggtggcctttactaattattttgctccaaataccgatgcgcccatcagtccggtcagatcactgcgtaattcgcactttggctttggaaatgggtttatttccagttatcaaagtgtccaacagtacgttgacggcatcttgaaggccgtggatgatcaaaagctgattgcccagcgtgagtattatgggacggtgcggttaaagcgtagcgataatgtttctgacctcctaaccaagggaattgcctacctggagctgagaatttacgatttagatccttttgaaccgttgggggtgtctgaagatgccgtcgacttggtccgtttgatgtttgcctattttgtcagtcatcgcccatttgatttgcggacggcggatgaagatattgctaaggcagaccagaaaaatgatgtcgttgctttggaaaatccattgaagattagtcaatatcatgatgaggcggcggaatttatcggtaaactggaaaagttcagcgctcaagctgttatcccattcaatgctcaacatctgtgttccaaattaatggaaatgattgacgacccggtgttgacgccgagtgggcgaatggctaattggctcggtgaagactcgaaaaaggtgtttgaagaactgttaaaatttgccaagggctaccaggatgatttgattcataacccggcaatcggcttcgaatcattgagtgccgcggaccagaaggaaatcttggcgaccttgaagcagggaattccggtgagaatcaaataagagtggagcaagaggcgttttgatcccagaatgtaaggcgattaagcgattattcccgggcctggaatgattgcttaattgccttacatggcggggatcagccgattgctgcacgtttcggcaaggtagaagtggtgctggtgcatggagcaagaggcgttttgatcccagaatgtaaggtgattaagcgattattccggggcttggaatgattgcttaatggccttacatggcggggatcagccgattgatgcacgtttcggcaaggtaaaagtggtgcggagtggtgtacaaaagttgcagactcatgtcaactaatgcttggaagccgccgcgaagagcccattatccaaacagaagttgcccacaaaaaaggtcggaacaataggctaaaccacctacgttccgacctttcaatatgaattggtaaattaataaaaactaggtttactccactcagtccccggctcacccaagcctaagctttcacgatggtaatccgcttttccggttaacaaatcagtgacaaactgagcaacggcttgtcgggtgacttgcgcttccttgaagggttcaccctttttagtaacgtgaacctgcgtattgccggcttgattatacagccaggtgatccgcaaaatcacatagtccaaatcactagcttcgacaatgtcggccgacttctttcgatccgatttccaaataattccggtgtgttctcgataccaggcttgaaacttgccggtaacttcctggtataaatcaggaatgttggcggcaatgaaccgggtgaccttggcttcatcgagaaccttcacaatgccgtcggtgatttccggtccggcaacaaagctcagatacaccgcatcggcgtcctttaagttggctttgattttatcaaactcggtgaaatcgccatcgacaaacgtcacgcggggactctttttggctgccaagcgagatgagacgttatgaccatacaagaccaaatcaaaatcggtttgagttaacaggtcatcagtcaccatttgaccaatctggccggctgctcctaaaatcattactttcaaaattttacctccattgggttacttatcgtcattgttccagcgaccgccgccacccagacgttcaaccatctttggatcacggtggtcaaagaatgccgattccttcatatccaggttttggatgagctgcatttcttcatcggtcaattcgaagtcaaagatgttgatgttttcaatcatccgctccttgtgaaccgacttggccagtgtgataacgtcccgttggtacagccagcgcagaacaacttggccaacccctttatgatgattttgggcaatttctgataagacatcgttggtaaataagccgtgcttgccttctgcgaacggtgcccaggcctctggctggatgcctaatttcttcatccagtcgagttcatcctgctgctggaaccagggatttaattcaatctggttgacttgtggggtgacctcgttatgctgcgctaagtcgacaaatcggtcggcgttaaaattggagatcccaatcgcccgaatcttgccttctttttgaagctcttccatggctcgccatgagccgtaaacgtctccgtatggctggtgaatcaagtaaaggtccaaataatccagcttcaatttggttaacgcctgctcaaactctttcttagtcgcgtcatagccggtatcactcacccaaactttggtggtcacaaacagctggtcacgagggatgttggattctttaatggcatcgccgacttcggtttcgttgccataagcctgagcagtatcaatgagtcgatacccagccgagagagcatcggcaacagcttgtttagttccaccgttttcgatttggaaaacgccgaaaccggctgctgggatttcaatgccgttatttaatttaaatgttggtgtattcatgatgattattctcctttatgattgtctttcaaatatggtttctgccagagtttctccgcgttgtcggcggtcatttcaccggcatcgaatttggctaaatgctcatcgaaggtgtcaattttatatttcagcagggcttgcgtgtcctgcatttctttgagtttttcgtttaaaatcgtcaactgttcatgcaaaatatccttttgagcttgccggacggccccacctttgcgggccagggtggcaaactcaatcaaagattcaattgacaggccggcgcttcttaaacttttcgccaggaaaatccaattcaagtcattggtttggtagacacgataaccgttgtgatcgcgtttaaccgggggaatgacgccaatccgctcgtagtagcgaagcgtatcggtagacaccccaagtagttccgagactttcttactgttcattatttcaatacctccgttcctcaactgacaaatacaatataaaccgtggagtggactccatagcaagtaaaaaaactttaaatatcaatttaatttatttcagatctggttatttgatttttgaaagactaaactgagtttcaaaggagtgataaatgaatgtgtacaagtgtgacttttctatctgaaacgggcgacaactttttagcccgaactatggattttgcttttgaattagatggccgaccaatcgtgatcccccgaaagcagcattttgacagtgatgccgcagaggctggatacgatacgacctatggttttgtcggtgccggcagaaacttgggccattatattttggttgacggtgtcaatgagaagggcttaagcgcagctgcactgtatttcagtggcgaagcaacctacgccaaaacggctaagacaaaccgggtcaacctggcaccccacgaagttttgaattggctgttgggcaatgccagtgactgtgaggacctgggccgcaaagtcgaccagctaaacatcatcgatgctccggtcaagattcttggcaaggccaccccgcttcactggatcatttctgatcgctcgggtgcctgctatgtcttggaaatgctggcagatggcattcattatcaaaagaaccccgttggcgtcatgaccaacagtccggactttggctggcatttgaaaaacctcagcaactacaccgagttgaaaccatcaccacatcctgcccgctcatataacgggtatgaaattacgtcatttgggcccggaagtggggcgctggggatgcctggtgactatacttctgtttcgagatttattcgcaccgtatttatgcgggaatatgccgatcaggtaccaactgatcaaactgtcaacgaactcagccacattttgaactcggttgaaattcccaagggcgttaagttgaagcaggatggcagcgaagattacacccagtaccgcggctatatggatatgaaaaattgtgcttactatatgcagccttacgataatcaaacgatctacaaggtgtccttgtcagaagaactgctgaataaaaaggcaccgagtgaatttccgattaaacaccaacaagtatacgaaacgcttcggtgaggtatcctcactgaatggcggttcgtgctcacatgagttgttaaaatctaagaaaaaacgctcgatcatccctttactggaatggtcgagcgttttttgaatagtgataaaacctattttctggtcttgtcagcgaccttttggctgcgattaatgaagtccttgaatagcttccgcgagtcctcataatgcttgtaaatgttttctggatgccactggactgctaatatctgatcattatctactgattcaatcgcttcaatcacttggtcatcggctctggcggtcaccttcaaatacggggcgacgtctttaacggcctggtgatgacgtgaattgacatatgggcgctggccaataatgtcattcaagcggctgtgtggatcaactgtgacgtgatgagatggcatgttgcctggggcttcctgggaatgtttcaaagtcgcgtgtaagtcctgggacaaatcttgatagagggttccgcccaggccaacgttaatcagctgcatccctcggcagattcccatgatggctttgccggcagtcacagactgtttcaataattcaatttcaaataagtcgcgtttgagataagtcatccccagcttctggaatggttcttcaccatagaaagtgggatcgacatcagcgccgccaaggaaacagacgccgtcaaacagtgtcatataatcgcgcacgtcttcgggattgacacttgggaaaatgacaggtacgccaccggatttaacgatggcttcgattgctggccgaggcgcgaacgcggcatttcgttcattaatgacgttggttgcctcggcgagcgtgtcagcaggtaatgcgattcttgggcgcaataaaatccctcctcaataattactttcagtctatttgtgttattgtactccaaactaataaatttacgtgatattttgattgttgtcaatgtaattgagcttatttgtcgacttttgatttgtcgggttcccaactgcctttgaataattcctgctttaattcgttggctgacagcttggctttattttcaaatcctttaaatgggcgaatcgactggagtgccgattgttggtagcgcttggcccgtttaatcgcatattcttccaaagaaccatttttcaaatgggtgattaacttggcacttggcgtggtgagcggattttcgacgcggtcttggaggtcttcaagttcttcttggtattcaggtccaagctggattctatccgcgtacatttccaagctttggaggaaggctctggcattggcttgatatttggaaacatcattgggatgttcttcggagacttcttcgttcatcttatccgaacgggcgatgaccttctcaacttcctcaggattcattgccggcgacatgatgaaatagctggccagtaaacggataaaccgtaacgtattggtccgaatccccacagaactgctggggtcaaggtcgagcattctcaattcaaggtagctgaccccggtcttcggcagctctcgcaagtgggtgttgcccttaaagcggacggcaccatggaattcgtaatctgaaatcagcttgccgtcagcgacgcccttttcaattcggtcaacataacgctgaacgttcgtgtagtcgccgctaaatggattgccaaagccgtgtgaactctggcggatactgcgaatcggtgcttttggtcctttacccggatcaaaatagttggcttcagcgacggggctggcgccaaatagatatgtaatgacccaacgataccgcagaaagccttgggcaatcttggcgtataagtagttttgcagctcaactttggaattgaaacgatcgctcatgttggccagaactaaatcaaacacgtggggatcgatactcaagttgatatgcgcgccacaaggcgttccttgagaaaagccgtgacgtttcagccattcttttaagtaggcttccttcttgggtcccattttagcgaggggaatcttgctcttgtcttttggcagtcgcggcggcatcgataacggccacaacagctcacctggtgacagggctgaccgcaaggcgttgttaatgctgaacaagtagtgcatggcgtccagggcatgagcggccggtggggtcacaacctcagacatggtttccagaaaatcattggtaatccaggggttggtttgttcgtcaccggccccggctgggtagggttcttggcttaaattgccattttcatcaactcgctgcatctcaatttcaattcccatggtaaagtctgaggttttcgcaacggcttcgttatcaaatattaactgaccaatttcactgaacatggcatacctcctagttgaattaaaatttgatgataattgatgacaaaatactaacactatcgcggactataagcaatgctaatggtgttatgtcacggagatttgtgctaaaattattttatttaattaatttctaatttagaggtggaatcatgagtatctttgtcaaactgggctggtatttcaaaagggaatggaaaatctacctggttggtttatttggcctgctgctgacggcgttggtcggaattattccgccacggatcatcggtaatctggtcgattcgattcataacggtaaattaacagctaaatatctcatgtttttgctgattgttttgacgattgtctcctttgcccaatacggagcccgttatatgtggcggaccgcgatttggggtgaagctgccaaattggaaaaagtgttgcggaatcggttgtttttccactacaccagtatggatcatgaattcttccaacgctatcgaaccggtgacctcatggcgcacgctaccaacgacctgtccgcgattcaacgagtggccggtggtggaattttgcagttcgccgattccatgattaccggcggcacgaccttgatcgcaatggtcacgttgattgattggcgattaaccctgatcgccattttgccgtttccgctattggcagtgatggcgcgatatttggggactaagattcacattgcttttcgagattctcaagctgccttttcacggctgaataataaagccgaggaaagtattaccggcatcaaggtcattaagggccttgggcagcaaaaagaagatatgcaggattttgacaaccaggttgccagaaccatcaacatcaaccggcgggtcaattttctggattctttgtttgacccgatgaccaccatgatcatcgcgctgtcctatgtgattacgattgtttacggtggctatttggtcaccaatgggacaattaccatcggttcgctggtttcgtttgtttcctatctggccatgatgatctggccgatgtttgccgtcggcatgctgtttaacacgttggaacgtgggaatgccagttatgatcgggtcatggacctgattaaccagcaaagcaaggtgattgacgatcctaatggtgtgacaattacaccgaagggcgaaatcgattatgacgttaagagtttctcatatcccggtgacaaacgactggccctgcaaaacattgactttaaagtgccggctggcaaaacggtcgggttggtcggcaaagtgggctccgggaagagtacgattttgcggctgattttacgtcaatttgataattataaagggtcaattaagtttggtggcattgatatcaagcaatataagatggacgctttaattcctgcaatcggctacgtgcctcaagatacgttcctgttctcacaaagtattcgggaaaacatccgctttgcccgtcctgacgctacccaagctgaagtggaacaagctgccaaaaaaagtgatttgtatgaccagattcaagcgatgccagatggttatgacacagctgttggtgaggaaggcatttcactttcgggtggtcaacgtcagcggctttcaattgcccgcgcgctgttaatcaacccggaactattaatcttggatgatgcgttatctgcggttgatgcggaaacggaaacccaaattctcgaaaatctgcacgctgaacgttccgataagacgacgatcatttctgcccatcggttgagttcagtgatgaatgccgacgaaattctggtgatcgatgacggcaaaattgttgagcgcggcactcacgatcaattaatgacccgcggtggttggtaccacgaaatgtttgagcgtcaggaactggaaaccaaagtgaagggaggcaacagctgatggctgattcatcaaagcatcaatctgcctggtcgaaatccattccggttaagcagcagatgcacattattgggcggctgttcaagtacgctgctccctataaatggtatttctacttttcagtcctgtttgcgattgcggttgccgttgtcaatattctcttgccaagaatcattcaaacctttatggacagccacttggtcgttggtcatcctgattttgcgatgatgtggttctttgccggtttgtacttctttggcatgttggcaaaggctgtgatgcaatttacccagacctatctgtatgaaatgggtgctgagtatatgctcgaaaataccagacggaaactgtttgcgaaactgcacaccttggggatgcggtactttgaccagacccccagcggctccattctttcaaggttaaccaacgataccatggcctttgcaaacttctgggccctgttcagtagtttggtggttaccatttcggccatggtttcctcatttgtcgcgatgtatttggcagacgccaaaattgccatgtggctgttggtgttcatgccgttcttgttcgtgacagtctggtactatcagcgatacagtacccgggtctaccgtcggatgcgtgaacggttgagccttttgaacgctaaattagctgaaggcattaccgggatcagtgtggttcagcaattccgccaggaaaagcggatcaatcacgaatttagtgataccaatgaccagtattataatacccgccgggcgatgattcgcatcaactcgttgttgttaaacccaatcattaacttgttctacgctttgggaacggtgctggtattagggatgtttggtatccgtgggctgcatggctatgtgcctgccggaattatttatgcgtttgtgacttatctttccaacttctataacccaatgtctgaaatgatggatcggctaagcgacttccaagatggggtcgttgccggctcaagagtgctgcggattatggatgatcagacctacgaaccgaagcagcacgcggatcccgatgccacgattacccgaggaaagatcgaattcaaacatgtcaccttttcttatgatggcgaaaatgatgtcctacatgatatttcctttgtcgccgaaccgggacaaaccattgctctagtgggtgaaaccggaagtgggaagacgtcaatgattaacatcttgatgcgcttctacgaatttggtgaaggggaaattctgattgatgaccgtgatattcgtgattacaccattcaagaactccgcaagaaaatggggttggtactccaggaacccttcatgttttacggaaccgttgcctctaacattcgaatgtttaaccaagaagtcaccgatgaagaagtccatgaagcggctcgatttgttcaagccgatcaatttattgaagacttgcctgatcaatacgactcgagagtgattgagcgtggtgccagttattccagtgggcaacggcagttgatttcctttgcccggactctggtgactgatccgaagattttgattctggatgaggcaaccgccaatatcgatactgagaccgaacagattattcaaaccgggttggccaagctccaagaagggcggacgaccattgcgattgcccatcgcctttcgaccatccaaaacgccgacttaatcttagttctggaggccggccggattgttgaacggggaacgaatgacgagctgttggagaaacatggtttctattacgatatgattcaacttcagaattccgcccatttggattagggtggtttgcgaattttgactgaaaaaatggttgatagcaaattttattttgctatcagccatttttatattacggtattaaattattgaatctcaatattgccgctgtcttcatgactgtcagcagcctttggcaatgtaatggtcaagacaccatcattgacttgagctgagatgttgtcacgatcgacaccaggcagttcgtaagttctggacatgacaccatgactacgttcactggcaacgacccggccttgttcgtccttcttctcagaatcacgttcttggtcgatgctcaatgccaagtcaccatgttgatatgccagatggatgttcttcttatcaatacctgggacatcaaccttcatgatgtagttcttatcattttcggtgatgtcagtctttagatcaccatttaccatgtagtcgttgtctgcatcagttggactgaagaaacgacgtgccaaagtatcaaagaaaggatccattgcgaaacggttcattaattcatttgccataataccaatctcctttgttgattattaataagattaattaataagcgtcaaaggtggtgaaacggggtcttggaatcacgttcccccaaaagaagctttactgaagtttcaaaagctgactacctgaatccctaaccaaccactccaaaatattcgtcaaaattactgaatatcaatgttgccggtttgatcttcgctttcagtgacttttggtaatgtcacatttaaaacaccattgtcaatgtgggctgaaatgttgtcgcggtcaacaccaggtaattgatagctgcgtgacataacgccgtgactgcgttcgctggcaattaccttaccgttttcatctttttgctcagatgaatgttcctggttaatattaattgagagaacgccatcttgatagttcaagtgaatgttgttcttatcgatgccgggaacatcaatctttaatgaatagtctttatcggtttcgttaatatcggtcttcaagttgccgaagttctcataatccttgtcgaaatcagaagggctgaagaagcggtgagccattcgatcaaagaacggatccaaatcgaaacgattcattaattcatttgccataatatctatctccttaatttcaaaatgattattcaagataacggggaacaacacgtcacttttttgttcctcctttacctttcaactactatgataatcagttttaaaatgaatgccagcatttagcactctaatgttgagagtgctaaaattttctcttgaattggtaatgtttgcacctaacaaagctcgcctatgcgcgttatcattgggatgtgctatgctgaagtgagaaatcaatgaggctgggtgaatgatcatgagcgatcgttttttcaacaaaaattttatttggaagataatttgggtaggcattgggacaattctggtctgcctgttatttctgtcggtcggattttctacccaactctcaccagcattagtcgatcaaaatgacacccccacccagcaggtcgatacaacgactacgccggcgtacagtccgaaaacgaatttccactggtcaaccaagacagttgcctactttattactaagcagacgaacggccattaccgagatgtttggatgcgggcagtcaaagcctggaatgcggtcggggtcgttgatctgataccagcagacaatgcggatcgagctgacgtcattctcagtgtcaaacaatcctatcatgaaggcggcggtacggttgagaatatcgccggtggggtggttggctacaccagcgaggaatttggtcacgtggacgggatcccgctattcgtccatcaaaataaaagttatttgattactgattccctgaagcaagcccactacgattctgtcaatgaacaagcaagcgtggcgatgcatgagctggggcatgacttggggttggagcacagtgacagtccccattcgatcatgcagcaggcggcgccgacttatttggatagtattcccgaagttgatgccaagcatttggcgcagttgtatgctggggtgccgcgggggtgaaagtagccgtattacctattatggtaatgtttaccatgcaaaaaaaagagcggctcagaaagtcgctccaattaatagaactctaagtattgaactcaccacacttacactgccagcaataccccgacagagtagtgaatgatcatggtgatgatcccaacaataatatttcgaataatagctgttttaaccaaaccattccccaatcgggcacttagataacctgtcaggccaaccgagaggcagacggccagaatggttgccggccactggaaggcaactggtgtcagcgtcatggcacacaaggggaagataccaccggcagaggcggaaaagagtgatgagaacgctgcgtcccaaggattcatgtagtgtcccaacttgaggccgtatttgacattgacaatcgtttccaaaggatttttgctcattaagtctttggcgattttgtcagcagtttctttggtgacaccctgatcaacgtaataatcggacactacgttgagctggtcttgataattagtcatcagtaatgctttttctttcgtcaccacagattgttcagtatctttttgggtactaacagacgcatattcgcctgatgccatcgaaaaggcacaggccaacaggtcggataatccggcaatgaagatcgtaaactgattagttgtcgcaacggcaacactgaacagcaccccaacaacggttaagatgccgtcgttggatcccaacacgccggcccgcagggtattgagcttctcatccattgtctgaccatcttttttctttttggaacgaacacttaccatgttcttcgcctcatttctctaaaatatgatgttcaagatccaattaaagtcccaattgtgtaggtgactaacatggtcaaaatcccggaaataatgtttcgaatcataccccggcctttgttggcgttgcctaattgagcggcagtgtaaccagtgatcgccaatgcaactacgacggcaatgaaggttgccggaatgcgaatggtctttgggaacaaagtaatcgctaaaagtggtaaaattgaccccgtcggaaatgaaatcatcgaagcgattgctgctgataatggattggtatattcaccaacgttgaagccatatttttgacgaaccgttgtcttgaccggatcttttgccatcatttcagaagttgcttgggccgctaaatcggcagaaatgccgtcacccatcagtttgtgtttgacggtgttgaattcattatcgtaagcggaacttaaggccgccttttggagactgatggcgtgtcgttgagaatctttttgggtattaacagacacccactcgcccatggccattgagacggtcccggccagcatcccggaaataccggaaataaaaattgcaaaattatttgatgtcgccccggcaacaccgataacgattccggcaaccgaaacgatgccgtcattggcccccatcaccgaagcccgcagaacattaatcttttgtgaaagcgatcttttcttcgccatatgctcacctacttcatagtttataatcattattatctaacaaaaattattttagtcctttattgtttaaaagtaaattaaaagtattgtgttagctaaccacgttatcatgtcgcttgacacatatgctgtgaagaaccaatttagaatcactatcaaataattagctattaactttaagaaggagatgccactcgtgaccaacccgattcttgaacaattaactcagcaccgtagtattcgtgaatttgaagatcaaccgttgagcccgcaccaagtcactgaattagtgaatgcggcccaacatgcttcaaccagcaccttttctcaacagtattccatcgtcagtgtaactgatccagccaagctccacgcgattgccgaagtcactggccatcgttggatggtaaatggcggtcactatttcgtgatggttgcagatcagtatcgaaatctaaagattgccaaagcacatggtatcgatccatacatgttgcattcaacagataaatttctggcaagtgtctttgacacggcgattgccacggaaaacatcatggtggccgcagaaggtatgggactcggcggcaccattatgggcagtgtcttgaacaatcccagaaaaatgattgaattattaaatttgcctgagatgacatttcccttattagggattgcactggggtatccaaaagacaaaccagaattgaaacccaggttgccaaaagcatcaatgcatttcgaaaaccaatatgatctgggtgcaaactttgaccaggaactcaccgattatgatcagctaattcgcgagtattatcagtctcgcagcaccaatggtcgatcggaaaccttcagtcatcacattgtttctgaactcagcgggaatcggaatctgcggtcggatttgtttgcgatgatccaagcccaagggctgatgactcactaaacaattattagtaaaaatagttgacttttgagatgtttaacattacattattagttaattgattgacagtcatttgaatttcacaatgttgaagagaagagtacgttgttgggctgcacaaagcgaccgctgatagtgaaagagcgggcagacaatgaccgaaagtgcgctcggagttgtggcatttaattaaagatgcattcgaaatgaggcgttttgtttttgacaagacgcaaaaaagggtggaaccacggtaattcgtccctgatgatcagctgatgctggttatcagggacgtttttgtgttcaaatgactgcaaaataacttgtgaggagatgattgacaatgagcagctgggccgttatccaacagagcttaccgatgtttgagaaggggtttcaactcaccttgtggctttctttcgtcgggattattggatccattattgttggcataattgtgagcctgcttcaatatttcaaagtacccgttttgcaccaagtggcatcgatttacgttgaagtttcgagaaacacaccgttattgattcagctatttttcctgtattacgcgtttccagtgatcggcattaagtttggtgccgagttgtgtggcattatcggattgatatttctcggcggcagttacatggcagaagggtttaccggcggcttcaacggcgtttccaaaggtcagttggagtctggtaaggcaatcgggttgagtcgctggcagcttgccagatacattgttttcccacaaggattctcactgagcgttccggcaatggccgccaatgtcatctttttgatcaaggagacttcgatctttacggtgattgccattccggaattgactaacactgcgttggatttaattgggatgtattaccggtccaacgagtatctattggtcttggttgttggctatgcgattattttaattccactatcaatcattttgactttactagaaaagagggttcgctatggatcattcgggaattagtgttttattcgaaggaaccaattttgagcggttgctcggcggcctctgggtaacggttaaaattgcggcagtggctttgattgtcggcctcatcttgggaattatcctgggtgttttgaggacctttaagaatcggccattgcgagtggttttgagactgtatcttgaattcttcaggattgtcccaaccgtcgtgctgctatttttgttctattacatcttgccacgccaattgaattttaatctccctggcgatcaattggccaccttggtatttgccttgtgggtggctgctgaaatgagcgatattgttcgcggcgccctaatctcggtgccgcagcaccaacgcgaatccggtaaagcaattgggctcaatcgttatcagctctatcgttacgtattgattccccaagcgatcagtttggaaatcccggcgaccatcaatttggccacccgggtcatcaagacgacttctcttttgatgctgatttctgtgatggatgtgattaatattggccaacaaattattgaagccaataatcacacccatccaaccggcgttttctgggtttacggattgatatttctattctatttcctaatcgactatccactatcttggtgggccaagcgactagagaagaagagattggagcgggcaaatggctgagcagattttacaggttgaacatttagaaaagtattatcaaaagaaacacgtcttacacgatatcaattttcacgtcgataagggcgaggtcgtcacgttattaggaccgtccggatccgggaagagtaccttgattcgctgcctcaacggtctggaggaataccagcaggggacaatcacttttgaggggaagcggattaatccgaccgagaaaaattggcaacagatccgccaaaagatcgggatggtctttcagagttacgacctatttccaaatttgaccgttatggacaacattttgctcgggccgaccaaggtgcaaaagcaggataagttcgcagccaaaaaggaaggccttgaattgttggaacgagtcggtctcgaggattatgccaacgcatatccccggcaactgtccggcggccaaaagcagcgggtcgcgattgttcgcgccctggcgttgcatccggattttatgttatttgacgaagtgactgcttcactggatcccgagatggtccgaggaattctcaacatcatccaagacttggctgatgttgatcacatgaccatgatcgtggtgacccatgagatgaactttgcccagcagattgctgacagagtgattttcctggaagatggccatattttggaacaaacaccttcaaaacagtttttcaacgcaccacaaactaaacgcgcacaagcatttttggatagtatggatttctaatattgaggaggaacaatttcatgaagaaaagatcatttaccagaattatcgccgttgtgagtgtcttcgctgctttattactggtcttaaccggctgcggtaacagcaagaagtcaagttcgcaaagcaataacccaagttccgttcagcagatcaagaaaaacgggacgattagaattgcggttttcggtgacttacctccttatggctgggtcaacaaagacggcaagcgagttggttacgacgtaacattagcccaccaagttgccaaagacctcggagtcaaagttaagtttgtccaagtcaatgccaacaaccgagttgatgctttgaattccaacaaagttgatctggttctggccaacttcacggtcaccccagaacggaaacaggttatcgattttgccaaaccatacatgaaagtttccgttggtgtggtttcacctaagaataagtcgatcaccaaggccagccagctaaagggtaagaatgtgattgtaaccaagggaacaactgccgaaaattacttcacgtccaagcagcctgatgttaaactgttaaaatttgattctaagacgcagcagtttaacgccttgaagaacggccgtggggttgcccttgccgatgacaactcatatctgtacgcctggtccaaggataacccaaactacacggtgggcattaagagtattggacctaagtcctacattgccccagctgtgaagaagggcaacaaatcacttcttgattggaccaataaggaaattaataagttgaccaaggagagtttctttgtgaaagattacaatacccaattgaagccttacttcggtaaagaagtgaaaccttcagatattgttctgccagttaaataatcattgattaggcagccaaaaaagcttttggctgctttttctaacattaaaaaataattagagttgacgaatcaattctaatatgttttaataagttcaacatttcaagaaaggaattatatctatgaatactcaacttcaacaattgaatgcctattattacggctatgcatggtttaagtagcgctcgtcagatgcgggcgcaaaacgcgttcgcgtctaacctgggcaaagtcgtaactttgttgctgccagctagacgctagagtctagccggatgggtataatttcttaagcgagtgaataagaaatatgtgttttctcctcaaataatcatttttttataagtgaactgtcttttttgccagccagtcgccagcgaattggacaataaagaccatgatcaaaatgactaacattgctgccacggtgacatcattttgataacgggcgtaaccgatactgatggcaacatcacccagaccgccagaaccaatcgccccagccatagtcgtcaggccaatcaaactaatgacggtcacaatggaggctcgaatcagatcaggcaatccttcgcgtaaatagattcggaagatgatttccaagtttcccgaacccattgaacgcgcggcttcaatcacctgcggatcaatttccagcaaggcgttttgaacttggcgggcatagaaggggaaaattcccacaactaacggcactaaagccgccgtcgttccaaccgtggtgtgtacgataaagttggtaatcggaaacatcaccgccagcaaaatgataaacggaatcgatcgcaataaattgaccactttgtcaaccaggctgtacacatacccgtcttcagcgatacccccttcttgggtaatcaccagcaaaatgccgatcccaaggcccaaaattccggcaatcagagaagaccaaaatgtcatataaatggtctcccaaattgactgaacaaattgcggccaaatatgggccacattaggaaatatttgttttaacatctttctgctctcctctcttagccgttgccaataatttaacgttgacgccgtgttgattcaaaaaattaattccatcggccagatgtttggattgtcccgacaagacaatgatcaaataaccaattgacgttgaaccgatccgttcaatgttggcaaataaaatgtttgctttcagtttatacagttctgtcaggtcagaaatcaaagattcctttgtggcttgaccatgaaacttgagaaagagtagccgttcattggcggccaaattctgcaaactttgatcggctttgatctgtgccaacgcttcggtcacatttgcggaggagtcgacaaaagtctgggttaaagcctgcttgggattcgagaagacagatgcgacatccccgcgctcaataatctttcctgcgtccatgaccgcaacgtgttggcaaattgatttaataacctgcatctcatgggtgatcaagacaaccgtcagccccaaactttcattcaaccgcttcaacaatttcaaaatatcatcggtcgtcttgggatccaacgcactggtagcttcatcgctgaccaaaatgttgggatcatttgccaatgatctggcgatggcgactctttgcttttgacctccggaaagctgctccggataagcctggacatattcacttagaccgaccaaatcaagcagtttcttggctttcaagcgtcgatctgttttactgattcgttggctcaacaatggatactcgacgttgcccaataccgttctggaatttaataaattaaagtgctgaaaaatcatgccaatctttttcctggcttttcgcagttccggattggcaagttgatctaaccgttggccaccaacaaggacgttgccactcgttggtcgttgaagcagattaatcgttcgcaacaaggtacttttaccggcaccggaatatccgatgatgccatagatatcccccttttgaatctgtaagttaacccgatcgaccgcctgcagcgacttgccgcccgactgaaaagtcacactaacatcctgcagatcaatgatggtgttttgtaaatccgccatatttcatccctactttcaaaaaataaaaacgcccctgtactaaagtacagaagcgtttaatcgcgataccattctgagttcacttcgttagttgcctaagaagtctcttcaaccatctcaatttgaaatggcgtgtctaataacgaagacgaacccgtctgccattttcattctgtgatcatgacagccaatcatcggccattttcaccacccaacagcgatcgacttccacccaatgtcgactctcttgacgctgtcagataactactctccgattcattttgtttaaatctattcaacattccaaacacttttcgccgtcttgatgaccagggccaatttatgccactgatcgtcttccgttaagcgattgccctcttcagttgaggcgaacccgcattgaggagagatacagagattgtccagtggaacgtactggctggcatccctaattctggctttgagaaagtcctctttttccagttgagggcgcttgctggtcacaattccgatcacaattcgttgatcccgacggttatcagcaatcttcttgaggggttcaaagccacctgaacgctcatcgtcgtactccaggaaatagccatcaatgtggagctgagccaggtaatctgcgactggatcataagcgccggccccagcccatgttgagtcgtagttgcccttgcagacatgcatggtaatcgtcagatcatccggcttgttatcgacaatcgcgttaatcgctttcacagccgctttggccaatggcaccagttccggtcgcaaagtctgcttggaaaagctggcccacatcccccacgaagtatcatcaagctgcagatagcggcaaccaaggtcatagaaatgttggacggtctgctgataagctttgatttcatcatccaagaaggtgtcaaagtccccatcgtaatagttgtcgaatacctccgcatccttgtttgggaagaacacggatggactgggaatcgtctgcttagctgtaatgccagctggaacaatgctgttaaggtatttgaagccagcaaagaacgggtgatccgggttgtaggcaatcttgccggtaaatcgaatgccgccctttcgcgtttcctcgccatgaaaattgtagccgtgctcaggttcaaagaactcagcgccattgaatccggcgaagaaatcaagatgccaccagctccggcgaaactcaccgtcagtcacatccttgagtccaagggcaacctgcttgtccacaattcgacgaatctcttgattttcaacctgggttaaatccgcttgggtaattttttgggcatggtaatctgctcgtgcttgcttgagttttgccggtcgtaataaactcccgacttcatcatatcgatatggaaattttaattttgctgcaactgtcattttgaccactccttattttttcgaataaaaaagtcctcatacagaataactctgtacaaggacgatattaatcgtgttaccaccttaattttcacacagctcacaccatgtgactcacttggtactcaaccaacttgaataccgcaacgcgataaggtgcgttcgccatgtcatcttgctggtgctcgacgacattgtgctcaaagaccatcttcaccgatttttcgccatccactttcaccaaatgtggactctctaaagacgcttccacgactactcatcttttcactgcttttgtttatcaatttaactaatgagtttaagctaaattatgagaaagtcaagggcgtattttaatctgaatggttttgaaattagaacaatacctgttaaaacgctatttatcgcgattaaagtgtacgatattctaatgaaattttcaagattcacggaagattaccaaactttctcatcacttcagattgcatccctgaaataaatcatctatgattcaaactatatctgtgacactcatttaacaaatccaccaacatcaaggagaaatcatgcaaccaactcaactagccgtcaacttaatcaaacaaatgccggaacttcccaccggctgcgaaattaccgcagtcacaatgatgctccaatacgccggccaacctgtcgacaaagtgaccctggctcacgaaatgccctacgatgccagcgattggaataagggcttcgtcggtgacccatttaccgagaacggtgacagcatttatccaccggcactagtcggtctggtcaccaaatacgccggtcatgcggtggatctcagcggcaaatcaatcacccaattaaaacaattcctggtcgaaaagcaacacccaatcgttgtctgggtcggccaattcgatggctttgccactcatgcgctggtgatgaccggctttgacgaccaacaggtttattacactgactgctggactggtgagcggactttcatgccgacagaagattttgagcaaatccgctcaaagaaaatgaagctggcaattagttattagaagtcttcgcaagccttccctgaacgaatacctgcttcacgtccgcctctgaagcgtggtacatgattttttcaaaaatttgatccatgctttcatcttcgaaagacttcaacggtgacttgaccacttgcaagtcagccaaatagccgactttgatctggccggtcttcagatgcaaactcttggccccaccgacggttgccaaatagaacccatttttagcagaaatcggctgctgattggttccccgctgtgccggtgccagttcagaattcaccccatcatttaacatccgcgaagacatcactgcttggcggatattttgatagatgcttggcgagtaaccaccggaaatgtcggttcccaggccaattttgacgtggtgttgcaggagcttgcttacgggcaacaccgcattaccaaaatagacgttggagattggacagtgggcaaccgccacgccgcgggctttgaaggtatccaggtcggcttgattgagcagggtgccatgagccatcaccgatttatcagtcaaaagaccatactcgtccaagacttcggcatcccgtttgtggtagtgttccagtgcataaccgttctcccaatcgctttcgctgcagtgggattggaccggcaaatcatatttctttgccaattcccccaggcccttcaatgattcaggcgtacaactggggacaaatcttggcgtaatgactgccgtttgcttgattggggcactctggttgagctggtcaatttgttgaatgaaacgttctgtgtcatcgactgcactttgagccgaggcatcccgatagttctcaggcgtctgatcaggattatccatcgccaccttaccgataaagccccgctggttgtgattgacgcaagctttcgccaattccaggttggcggggttatctacactgccaaaatacaggacggtggtcgtcccatttgcgagcaattcaccgaccagatcgtcataaacccgcttggcgaacccgacgtctttgtacttggcttccatcggaaatgtatatgtatcaagccattcatttaacggccgatccagtgccaccccggcattgggccactggggtgcgtggacgtggaggtcgatgaagccgggcaataggtattcatttgacttcaacgtgagcaactgatcattttgctcggcgtcgcgcctaaccgctggaaaatcgtcatctgattcattgatcacgcgctcgatataaccggaatcgtcaatgcagaccaactggtgctgttggcagtcgacctcatcaggtgttgcagcagtcatggtcgggccttcaattacttttgtgattgtgataatagccacctcagttttcattattttttaaactaactattcaaattccctatacaaagtgattatatactgccaaatgtcccgactcaatgcatgccatttcaccaatacgaaatggcatggacttttcaacaagaaatgtcggataaatttgtaggaagtgccaaacatttccaccccgtcacgatttatactgcggacgaagtggtgttcagcagtcaggttaatcgttattgagggggttaaaatgatgactcaaaagaggtttattcaggaattgttcattagttcggtggttttgctagggctattggtgggcacaaccggctcggttaaggccgcaagcacccccaccatctcagagctcaccagtttcatctggcatcgtgcagcctttagcggccgtaccccatcagaccggcgaaattgggacagtgacataccaaattagtgatggcattctaagtttgagtggtgggaccatctcaagccaccccgaagaaacctatccatggaattttaatgaaacgatcaccaaagttgagatcaatggaccaattattctggagggaaatgcggcccgtagtttctttatggcgttaccaaatgcgaccgcaatcgaaggcatcggccacttagataccacccaagcgactgacatgagccacatgttcgctgatgataccaatttattggagctcgatttgtcaacgttaaatacagataacgttacccgattcaaccagatgtttgcgggagaccaatctttaaccactgtgaatgtttccaagtttgatacatctaaagcagaattaatgacgggcatgttttccggcgaaacttctttaaccagcttagatttatccaactttgatactcataagccgttgctttacggagcgcggaggctgtcaaatatgctggcatacctgaccagcttgaccactctcaaactaggtccaaacgtggggtttggccctgccgagagtatcggcgatccacacctgattgccccggctggcgcagacaactggcaggcagtcggcagtggtaccccagaggatcctgaaggcccagtatactcgcccgatggcattcgcgggttatatgaacctaccaatcctgaacacccaactgaagtggaaactttcgtaccggaaaagccgtttgttgatcaatcggctatctcggttcaaccaacatacagtatgacaaccggaaccaagtttgatgtcagcaaggtcttcaactcaattaccacaccagaaggcaaagtcggctacattaccgccaatgccaagtttgtcactaatctctactaccaatcattgcctaagaataaagagattacgctcattgcaacacgaggcattcaagcctacaagaataagaatttgacccgaaagacaaaggcttacaagcaaggcacccatcttcgagttaaagcgatcgttaagcataatctcacgacacgctaccagttgagtaacggttactttgtatccgccaataagaagttagtcattcagggaaaagcttaactgaaagcagttcatatttttagccaccagtatcgtgctggtggcttttttggatgctattgagaatcagcagcacaaggaaaacctatcgtggactttctcacaacaatgcccctgcaatctttgtacaaaccaacaaacaaatctctccatcttttccctatactgaaggcaaattgaacctggttcaggttttgacagtttgtaaacgttgagggggcgttttctatgaaacagagaaaaattgtgatcaaagtggctgttgctatggccgcggccatgggcttgcttttagggacggctgccagcacgaatgttttgactgaagcagccgaaacaaataccgctgttcaagatgagaccgccagtgggcatttgggtggcccagatggtccagactggacccgtgacggcaataatttcaatttaacgggtggtgtcctgacggagagaattgacaatcaattgacttcaaatataggaacggcaaccgtgattaatattacaggtaagctgtatcttgagggcgaggcctcgcgtgagttgttttcctccctcaataatgtgaccacgattaacggcatggagaatgtggatacggcaaaagcaacgaatatggagttgatgtttgccgaagatcaagcactcacctccattgatgtgtcgtcctttgacacccgggaagtcaccgatatggcagcaatgtttgctaatgacagttcaatgaaaagcatcaatgttgccaactttaatactgataatgtgacgattatgcccaacatgttcgccgatatgcacgaggttgaaagcatcaacgggaccaatttcaatacccaaaaggtcacagaaatgacggcaatgttttggaatgatcctaacttaaagacggttgatgtgtcgtcttttcaaacaccaaacgtcaccagtttcagggcaatgtttgcggatgattcaagtttgaccagcctcgatttgtcagggtttgacacccaaaagctcctaggatattctaacggaaccctcggactcatgctccggggaacatccagcctcgccaaactgacactggggccaaatattcaatttgataaaaataagaccattaacggcgcgtctgctgggctcccatcactcggcgcccctgccggctctgaacgatggcaggcggtcgctgccgataaaggcggtaccgccgacaaccctaaaggagcgactgccttcctccccgatgaattgacttccctttatgatcagtcgaatgccaatcatccaaccaaggttgagacttgggttccctacttcaaagacactctggatgttaaatcaccaattaacctgacagtcggccaatcatttgatcccaaagcaggatttgtctccgcagccgatggaaatggtcaaccggttacttatgaccaagccgtcgccgaaggaaagcctggcggactggcagttgacaccagcggtctcgacacctccaagccgggaacctataacgtcacctacagctaccacatgcgaaaggccattgtgaaggttattgtgagcgcagtccctggggtgacaccaaatccgaccccgacaccaaaccccaatggcaataattccggcaacagcaatcccgtctggaatcccaccaatccaaagaatccaaacggtactggcctgcccaactttgccaatgtgaaaaacgatgcggtctacgcaaccaagaaaatttacctctaccaaaatccaactttcaaaaagtcacagcgaatagccgtttatccaaaagctaagcgaatcaaccgaccaatgtttgtcgtcgtcgattttgccaaatcaaatggcggtgccctccgaatcaaagtgcgtgacgtcaatcacggcaaaaagactgctggcaaggttgggtacatcaccgctaatccaaagtatgtaaccaacgtctactaccagaccatgccaaaatccaatcaggtcaaggtgatcgccaccaagggtgtttacgtctaccagaatgctaatttgtccggcaaggccaagcactacaagaaaggggctcgtctgaccgttaagaaattggttaaacacaatctgacgacccgttatcaattaagcaatgggcattttatcaccggcaataagaagctggtcattcatagccgttaagggcatcaattgtttcagaaagtctgcgcactctcaccatcaactgttacaatcaaagtaatgggcgtgatcgttgtgtgcgcatccgacaatttggctttaaccttcccgcccagaaaatcactcaaggaggaatttctatggcggtattttcagaagaacaacggctgcaaattttcaaagagctcgtcgcgattcaatcggtgaacactgatgaagaaaaggtcagcgcttatttaaaaaatctttttgagaaacatgacatttcggccacaattatcccggtcgatgaaaatcggacggatctaaaagcagaaatcggcactggcagcccagtcctgggagtctccgggcacatggatgtcgtttcaccgggggatacctctaagtggaccagcgacccgtttacattgaccgagcgcgacggcaagttatacggtcgtggtgctgctgatatgaaatccgggttggctgcaatggtgattgccatgattgagattcatgatcaaggattgctgaaaaagggtcggattcgtctcatggcaaccatgggcgaagaagttggcgaattaggttcacgaaccttcgctgacgatggctcaatggacgacgttgatgcactgatcatcggtgaaccatccggctaccgaattgcctatgcccacaaaggggcaatggatattcgcctaacctcaactgggaaagctgcccatagttcaatgccggagcagggctacaatgcgctggatccactgattgatctcctgcacgacgccaatcatcaatttagaacaacaaataaaaagagcgcaatgttgggaaatctggcatttaacacgacgatcttcaagggcggggatcaagtcaactcaattccagccaaagctgttgccgatatcaacgttcgcaccatcccagagttcgataatgatgtggtcgataagctactggatcaactcgttgaacagcaaaataccaacggggccaaaatcgtcaaggaaacttacatgtctcaaccatcagtcgaaacgaccggcgataaaaagctgatcggcttggcacaggaaatcggcaaacaatatgccgaaaaagacattccgagcggtgccatcccagctgtcaccgacgcatcgaacatgctgcgggataagccgaaggaatttccatttatcatctttggtccaggaagtaacagtgtccaccaagttgatgagtttgtcgacaaacagatgtaccttaactttgtggagatttatcagaagttgtttacgcagtatttgaactaaagacgaatccaatcaaatagcagccgtcaaaccacttgcttgtgatttgacggctgctgttttgttctgatagatactaccaagccaactcataataagtgaaaaatgcggtgccagccccgacccacacgagcaccatgatcacaatcatgagactcttaacggccgcattaaaaattgtgtaatcagcgaaccgctggtcaatccgcttgggtgcagaaatcagtcccagcacgattaacgtaacaggtaagataaaaatggtcattttggtgcctggactgtctgcgacgccaaagccaaaatgagtcggaacaatttgaggtaatcgtggataaaagacgatggccgccattgcggtaattatggtcacacaccagtggacggcaaggattttagagtaaactttggaaatcagaattgagaaattcatgtgggtcgcttccttagtggctatgtactttttgttaatgctgtggtaatcatatcacggttaactggtaacacaatccttatttgggcatcggatcgaattcatttgaaagtgaatatccaaacgcctaacaactagcacaaagtccccgttgatgatacgataaaaccaaaattatctctatcaaacaagcataattattgcatcagtcaatcaggggaggaattattatgcagtctgtggatgaccagttaaagcagttatcaccagaagaactcattaaattaacgtctggcgccaatttttgggaatcggtgacactgccagaccaccagattcccagttttcgaatgagtgatggtcccaatggccttcgctatcaggcgggtgaaggcgatgcactaggaataaatgacagcgctatcagcacctgtttcccaacggccagtgcggttgcctgcacttgggatccggatttggtcgctcaaatgggccacgccatcggcttggaagcccgcagcttaaaggtggatatggtgttgggaccggggatcaacatcaagcgaaatccgctttgcggccggaactttgaatatttcagcgaagatccttatttagcaggcatgattggtgccggttggattaaaggcctacagtctgaaggtgcggcggcctgcttgaaacactttgccggcaacaatcaagaaaccgatcggctgttatcaaattccatgattgatccaactgccttgcacgaattgtatctggaagccttccgaattgccgttgaatctgcgcagcccgaaggcgtgatgtgttcatacaatcaggtcaacggcacttattccagtgataatacctatttgctaagcaaagttttgcgtcagcaatggggattcaaaggcgccgtcgttactgattggggcgcgctcaatgacaaagtcgccagtctgaatgccggcggcgacctggaaatgccatccagtcacaacatgttcgacccgcaggcgctcgaagctttgaatgccggccgactcaaacgaccagctcttgaccgagcagcgggaaacgttgttcgaattgctgagaagcagcggccagagttcactggcgatcgcaaggacctactgacaaaaaatggccaacttgcccaaaagattgccgaaaacgccgcggttttattaaaaaatgatgatcacattctgccgattgacccatccactaagctctttgtaatcggccagatggcagccgaaacccgttatcaaggtgccggatcttcccacattaatcccccatctcagacctccattttgcaaggattaaccaatgccgggattgcctacgattatgcgcagggctaccaatttaccggtgaaaacaaccgtgaattggcgactgctgccaccgatgctgctaagaatgctcaaactgtcgtggtggttgcagggttgccagaaagtgccgaatcagagggctttgaccgtcctaacatgaagctgcctaataatcagaatgagctgattgaacaactggcggcggtgaacccgaacgtgattgtgttactggttgccggagcgccggtagaattgccgtggcgaactaaagttaaggggttgatcaacctctatttaggcggccagtttgtcggcgacgcagcggctaatttgttatccggtaaagtcaatccatccgggaagcttgccgaaagttacccgattacctatcaggacgttccgtcggctgaactatatgaccacaatccacgttcggctgcttacgccgagagcgtctatgtcggctaccggtactatgaaaaggccaaccaaccagtcgccttcccgtttggcttcggtctgagctataccagctttgaaatgagtcgtttacagttaaatcaacaccaaattgacgccggccaatcgattaatgtcaccgttgacgtggccaacaccggcagccgtgatggggccgaagtcgttgaggtttacgttggcaatccgtctgaccgcgccttgaaaccattgaaggaactgaaggcctttcaaaaaatctttttaaaggccggcgagaaacagacggttacccttaccttgcctgctcaagcctttagcgagtgggatgagcaacagcaagcctggcagctgcccgcagtttcgaagaccatcatcgtcaaaattggatcgcgccttgaggaactcaccgcaccagttgaagtaatcggccaagccatcaccccaactgattccatcccgagttggtacacccatccagtgggcaagccgacgatcgccgatttcaccgaactgactgggatgaccgttgcgccaccatcaacgccggaaccggggcactataccccattgaacacaccgcgggagctgagtacccactcggcgattattcgcaaaatcgtttcagttttaaaagccaacatgaccaagggcatttcagatccaaatagttctgaagccaaattcatggatgccatcgtcatggacacgccactgattcggcttgctcaacagtccagtggaaaactctcactcagtttggtccacaaactagtcgcacttgccaatcggcattatattcaggcaatctttaaaaactaatcgttgtatgtaagggggaagtattatgacacgaggggcaagatggcggttggcatccgcacttttatcgatttcaattctcttaaccagcgccaatgcggtcgccggaaccattccgatcatggcggaacggttcccgtcgattccactgagccaaattgaaagtttgaccaccattcccagtttgagcgtcttgatttttgtggtcttgagtaatccgatcgccaaaaggttaggcaacaaagcaaccgtgttaattggggtcttcatcgtcctgattgccggactgattccgactgtcgccaattcattctggctgattttgggatcgcgattcctactgggtgccgggatcggcttatttaacgcgatggcctacagtttaatcagctattattacgagggaacgcaacgccagaccatgatgggctatgaaggctcggtgaactcactgggcaacattttgatgtttgtgttttcctcaattctgatcgggtttggctggcgccaagtctatttatactatctgattgccatcccggtcttcatcctgttttggtggggtgcgccaagtgaccgccaggaaaagcaaccgcaagccgatcaagaagcggccacaccatcagttggcttgggggaactactgaaaggccggttaatgatttatgcattattagtattgttcagtatgatgattgcccagacggtgatcgttaaaatttccgggctaattttaaccggcggctacggcaaaattgccgatggcagcattgccctggccttcctgggggtcgccaacatgattggcgggactctttacggccagatattcaaactcattcatcaattgattttaccggttggcttgctgattgccgcggttgccctgtttgccctggcgcgatcccaatcactggcgcttacctacaccctcacggtggttgccggattaagtacgtcgctggttggaccctacttgtttgccagttctgccgaaatcgccggcaaaggcaacgaaaccttggcctcttcaattctgattgtgggaattaatatcggtgtattcttaacgccatacgccttgtcgggattgagccatctgatcggcagtgatcagccggcaccgattttaatcgccgtcagcgttgtcttggcggtgattggtgcgttaaccttcttcatgaaagaacccaatcagcagtctcaatgatcacgccatttctaggccatcttaatcagtccaacgccgatgagcatcagcaccattcccaatgcttgagcaggcaccatctgttgtttggtggaccgccaccagccgaattgctgaatcagaatcgagccgataatttggccgatcaaacccatcatgatcgttaggccagcgccaatttgtggaacggccaccacggtcacaaataaaaatgtgccaccaagaatgccacccaaccagttccaaggttgggtggttttgagttgactggcggtggggacacgtttatcaatcatcagcgcaacggcggcaatcaaaagcgtgccgatgaaaaacgaaatgaaggccgcttggctggtggaatgcagtaacgttcccaaatgaccattaattgcctgctgcatcgcggccaacaccccaacaatcaccgcccaagtttgccagccaatcacgcgtgtcggcccgtcttgtcgagtaacgttggcgtcaaatcggcggacatcgcgattggtgaggctgggtaaggcaactgccaccagaatgccgacaatcaaaatcaggatgccaaccagccgccaagcagtcatggcaactttagccgcaccgaaccaccccaaccaatcggtcacggttcccatcgtgatctgccccataatcggtagaatcgtcgtttgaatggcaccaattttgggaaacagtaggatatttgacgttagataaatcgagcccagcagaccgcccaaccaaatccaggctggctgcgcttggatgaatctgccgcttggaaacagtcgtccagtcattgacatggcgagaatcgctaaaaacaaggtgccgataatgaacgaaatcgtcccggcaataaacggcgatttcactagccggcttaaatcggcattaatgggactttgattagacaacaggaacccggcaactagggaaatagtcataaaaatcagcattgttttccaccttcaaatcatgaaatcagactatttgatacacgacatatagtcgaaagaaaagcagtcaactatttcaggttaactgcttgtgtgaatgattggtcacgtaagtaaagatcaccagtttggatgactgtattatacaccgcccatctttgaaatctgaagatgaaccgaaccactttcctgaatgcagcttaaacaacatgcgcaacgcaatctccataaatgtgattcatttaataaatgtaatcgctttcaagactccaactaaggtgctatcgttaaccacgaatcgtgttcctcatgagtttaaggaggtcatcaacatggcagagttggacggaaaagttgccatcatcactggtggtgccaatggaattggtctggaaacaacgaagctctttctccaggaaggcgcaaaagttgttttcacggatgttaatgcggatgcaggtaagcaggtggaagatgaattgaataaccagaacgccctattcatccaacaggacgtcggtgacgaagcagcttgggaaaaagttgtgaagacgacgcttgatcaatttgggacaatcgacattcttttcaataatgcgggaatttacattattggtaaaattgctgatttaacagtcgatacttggaataagttaatgcggatcaacgtcctgggaactttcttgggattgaagcacgtcctcccagtgatggcagagaaccatcacgggtcggtcatcaacgcatcatcaattgccggaattgccggttcagccggtcatattctctatggtgccagcaagggtgccgttagaacgatgaccaaggacgctgccgcggagtacgccagcaagaacgtcagagtcaactcaattcatcctggctacattaaaaccgggatggccgactacgcctcagcatcccttgggataccagagaatcaacttggcaagattttcccgctgggtcgtttgggtgaacgaatcgaagttgcccaaactgttgtctttctggcatcggataaagcatcatttattactggggttgagttgccgattgatggtgggttcttggcccagtaataagacgattatttgtcagaaagcgactgacgggtaaggtttgaatgctccggaatatcgtttcaaagaaagatgtttcctccattaggaacggctctcaaaaaaatgggagccgttttcattacgaacaagattcattttgcgatctgcttattaaggaatcgtcaaatcaccacaaatcttttatacttgagataaacaaaactgcactccaatgaaagcagaaagaagatgctgacaaatgacaaatccagaaatcgtgtcctaccccgccatcttcagtaaccaagacaacgacagctattatacggtgacattccccgatattccagacacagtgtcacaaggcagaaccttggaggaagcactccgcgaagccccagatgcaattgccgtcgcgttacccgattatgcggagtatcccaaaccgtctaatctccaacgagtacaggctgaaaatcctaacgcaatcgtccgcttggttcgcgtaaatatgaaagaaaagcttgaagcaatgagatcaaagccaaataatattcatcaattattcagtggctggtcagatgatggtataagagatactgaattagactggggagatcggcaaggacaagagtttaaataaggacttgatcaacagcttttaattgcctgaattctacatcggatcaggctttcaagatgcagaatattgattcgaaggagtttgaaaaatgaaaacaataaggcatctttttatcatcacaatcgcattctttgcattcatcgcgatctcaaccgtcatggttcgcggtgattctctcgatgaggacactgtgcctgttaatttgaccaaaaaatcgttggccaaaatagaaaaatcatattcagatgtttggaacaatgtaaagtattaccgtgtcaacaaaactgtcagactcaaagtaaagtttattgatcgagatacagagaaaacaaccaaagttgccagcatcagagtacccaaaaacaccatcttggcgggaagtaaggaccacgttgaggaaacaagagaaaagttcatcaacacgtttggcctcaactacgacaccttcagttatcgattcttgaagcccgtccttagttccagcatgaacttattcacatatgatgcgttcgtcaatgcaaaaaagatgtcatcaatcaacaagtatttctcaagagtcaagcgcccggcgtatatgcctgcctattcttcaggatcactctatatttatcccactaataagaaaaaattcagtccgttcagtccaacgacaaatcgtttgaaaataacctctgatggatacctggaattcaccaaaaataatagtcctgacgtcgaaactaataagtcatttaatctgactccagattcacatgtcaaaattaacaagacgatcctcaaaaataattcaaggtatttatactacgcacaccatttggcaggtgttactgataagcaggtcgcaaaagccggtaaaaatatgtatagattaacaattaccaacttgcatcgacctttctcaatgtttgacggtgatcaaggagccgtcttaatgagcagatacaaagttggggacactgtatattacacaagtagcggcggatatagtgcgtagggagcccttcactggcgattccacatcctaccttaagcgcaaaaaaaaccctggcttgatcaccagggctacatatcactcaacctatccaaagatgtgttttctaaaccggctgagaaacattattaaaatagtcaaccaaaaattgtgaaccgttccacgtcactttagtaatactcccattgattgttggcacgtaaacgggcagattactccaatgcgcaactaagtttcgaatggcggttccatgagttgcaaccaaaatctgatcatggtcagcggcctgagaaataatttcttgaatgccgcttgagaagcgttcccagaattcagcgctggtttccgcatcctgataaggatccgcagaggcaacacggtcctcagcctcttcaattgagtgttttaaaatcatttgctcaaacgagtcaatgccttcttctccgcctaattcatgccacaactgattttcatcactgccttcaaaatacccgtagttcaattcacgtaatgcttgcattggcttcaattgcagttttggagagacttcctgattttcctgtaatatcagcttgccggtattaattgtccgcattgtatcgctggtataggcttgggtaaaatgaattcggctcagccgactgccggctctttttgctgcggcaattccctgctgagttagcggagagtcacaatttccttgaatccgattatatttattcaagaacgtttgcccatgtctcacaaaatataaagtaattgacatcaattgtgcctccttcgatgactcaacttcgcagtaatactgactggtctctttgagcccaccaagttaatcgtgattagcgattactgaatgtcaataaacggtagttgaaataacgttgccaaatccttaatttgttgttctgaagcagtaaatgtcaaaacggtatggtgaccgccgccattttgaatccactcggttgcaccatgtttcagacccatctttggagtccaatattgtttggcaattggcagatatggtgtcttcttagtcggtttgtgggcagtcacgccataaccgatcattctaaattcggttccaaagtcagaaatggttacatccatggcatcgccatctattccgtcgaacacgaggcgggctggatcgtccttaccaccaataccaagtgggtgaacttcaacccgtggcttatcactggcaatcgttggatcaacttccagcatgtgcgagcccaagatggcttcgttgcctttggtcaattccaaagtgtaatcttccataaagacagtccgatcattatgggtcataaccttaagtaaacgatcaagcgcagcggtcttccaatctccttcgccggcaaatccatatccttctgccattaacaactgcacggccagacctgggagctgttccatcccgaacaagtcttcaaagttggttgagaatgctgtatagccacccttgtcaagaagatgcttgatgccaaagtattcccggatctggtagcgaacggagtgctcgtattttgcagcatcattatcaccctgaacgaaggtatacttttgttggagttcttggtacttattgtcgatatcagtgtcagaaaccgaattgatttcttcaaccaaattgccaactggccagtaatcaacggtccagccgaattgaatttgaccctgaatcttgtcaccttctgtaacggcaacatttcgcatggtgtcaccaaaacgggccactttgatgttgaaactttcattgtaagcaactgcaacatcttcccaatcggcaatttcttgttgaatttctgggtcagcccagtgaccataaatgaccttattgtgcttctgaagtcttgcgttgatgtagccgtactcacgatcgccatgggcactttggttcaagttcatgtaatcaaagttgatggtgtcatatggaatatgatccaaatattgggtagcaagatgcagcaatggcttttgcagcaacttagttccgtgaatccagtttttagctggggaataagtgtgcatccaagtaatcacaccagcgaccttatctgtataattggcttccttcatgactgctgtaatttcatcagcggtggtagcgacagctttaaatttaattgggtagggaagcttgccggaagcattcaatttgttgataatatcttccgtatcagaccgaacctcgcctagtatttcttcgccatagaggtgttggctgccaacaacgaaccaaaattcataatcagggaccttaagcattgatatttctccttccgcaactttcaaaatggggcgtttgaagttgacatttaatgaaaaatcattaaatttgattgtattattgaacgttgtttcgcctgtctgttctaatttccagaacttggttcataaacgtttcaacacagtcatcataagggaacactgactcgataaatgcacgatattgcatgaaaaaatatacatatttgatagtaaatgatcactatttcaatcttgaaaggaatctattatgagaatcgcatttagcaacctgaatgacaccatgcccatttcttgcgaatcaattggctatcactggcggcagtatccaatataccggcccaatggctaccgcttttttcactggttacaaaccgaaagcagctcgggaaccgtcaaaattgatggccagcaaatccatctactgccaaactccggcattctcattcgccccaccgttccgcattcttatagcgccgactcggatgccaaagaatgggatactgcctacatcaccttttacggtccacttgcgaactacctggtgaactatctggacgtcgaggactatcgggtgtttgaagatttacctgaaaacattaccaattttatccaaagcaactaccgggcatttatcaacaatacaattgccgaccaagccaaccaatcagtgctgatctatcgctatttgctgctgcttcaccaaatggatatcgtccatggccaacaaagcaaatccgatccgatcgttaaccgtatcaccagctttttggaaagtaattatcaatttaacattaccaatcaaagcatcagtaacatcaccggcctgtcgattccttaccagacgaatattttccggcaaaaatacggcgtgaccccacttcaatatttgtttgactatcggatccggcaagctgcctatctactcgtcaccagaaaggatctgcaagtccaagaagtgtctgagcaagttggcttccccgacacatccagattcattaatgccttcaggaacttttatggggtgacgcctaagcagtatagtaagacggtgtatcagggtaataattgatgacgaaggctcaattaaaaagcaagaagtgacttataacggaatgccggttacttaacgatttgcaaaacaaaaagtgaaccgaaccccttgaattagatttctccaattcaaggggttcagttcacttaatcacaagatccgcttcacaaaaggatagtcgctacaaaaagattttgttaacaaaacacgccaaccgctatgcaactcggattgatcaattttatcagcaaaataacaaagaattaaggcatgttctcggtgacaagaatacagatactcttgtagaaaatctgcatcaaattcaaaaatattttgatgataagctgaattgacagacattatgatgatctctcaaagattaatagattaactggtagagcctactccgacaattttctacgccctgaacaaacatcagcagccctgaacagctgatgttcgttcagggctattttgtagtgttctgattattacatggcataaaacatttattaacgggagcgttaaagatgagcgaaccagactttcgtgaagttaatcgctcctgctttttgactgataaattggcaataaaacatcatcaactaacaattccaatttgcgctgcgttaacggctgattagtaaaaagttgaaatcttagccaatcgaatggtagcaatgcaatctcttcaggcagatctgtttttatgatctcgcctcttttttttgcccgtgtaagaatgtgatcaagagcattaagatcgatcgcatttccttcgctcattaattgttgaatcgtcgtattttcttctttagttgcttcccccagcagttctgtaatacggaagtccttaaatgtttgcatactaataatgaatcgttgaagcagctgcaataaatcctcgcgtaacgaatgaccagtcaaagtgaaatcatccgttcggccgtgattttctgacgttatcttgtcctgaattgcggcaactgccagagagaatggcgtctgccatcgacgataaataacagatttactggtgttagccaaatcggccacatcagcgaaattgaaacttaaaaatcccttagttttcagaagctgtaaagctgcctgataaatcgcttgttccagttcggcaccccgacgacgtttttgaaccataatgatgactctccttttttaagatactttaagtatcttattgcattttttatcttcatagtgtattatatcaattattgttttaggatactaatagtttcttatttaggaggaaaaatgtaatgaataaacaaatcccaaaatccacaatcatcatcgcttgggttgtcgtctttggtgcaatggccccattacttgattcaacaatgattaatattgctattaataagttagttaatagttttaatagttctgtcacaacagttcaatggaccattacctgttatgtcttggcaactggaattgctgttccgttttcaagttggttattaaataaatttgatggtaaacatgtctttatgctcagtgaaatcttattcggcatcggttccattttagccgcagtttcaccaaacattcaatttctaattggagcccgcctggttcaaggctttgctggtggcttaattatgccgttgctaaccacccttttagttcaaactgctggtgccgccgttatggggcaaatgatggcaacggtcggtttacccatgatcttgggtcctctgatcgggcctgtcatcggcgggattattattaaatttttgtcttggcaatggattttttggattaacgttcccgtaaccttgacgtcactcggtttaattatttggaaaatgcctaattaccctgcacaaaataaatccgcaaaattagatctcatcggaacactgcttctgattggatccagcaccagtatcatttatgggatggttaaagctgcccacaaggccaattttagcaacccgtcaacactcacttttttggcaacgggcgtttcgctgctaattatctacgttatttggggcgccattcggggcgaaaaagcagttattccgcttaatttgtttagacatgggtccttcaatggatcagttattggcttgtttattgctggaactgttcttaatggtgccatgttattgttaccactctttttccagaacgtgcgtcatatgagtgtcttgatggcctcactggcgttgatcccccaaggattggggatgttgatttcccgcccactcaccggccgattgaccgattcaattggtgcaaaatatgtcgttcttgtcagtgtgtttattgcttttgttggtacgattcctttttactggatcacccaaagcacaccgtactggatcattgccgttgttctgctggttcgtggaattggggccggtggtattttgacgccattgatggctgactcttattccggaatgaggatcgaccaaatttcgagcgccacaatcggttcacggatcttgcaaaacatcggcagtgcctttggttcagcattagttacaactgtcgtaactgctttttcagcttcgcacgttaaaagctttcagcatcaattaaaaacgggtagcctcaaaccggcatcagggcaattggctgcttttatccaccaacatttagttgctattcgacttgacgcatttcaacagggatttttaatgatttccctggcagcactgttgatcattctgccgaccctactactttctaacaaaatgaaatcaaaagaataagcagatgcaggttgccaaactacgtgaagtattcaagagcctcgcctgaaggaaggttgattcgatcatgaaaaacgatatcttaacaatcattcatgggtggtacattgcccttggcgttgtcctatggcttacactcgttacaatttttgtttcgaaacgatacctcagcagctccccggttaattgggctaaattgtatttaactcctatactatttattgtatttggtattgagaaaatcgtccgctttcgacatttggccgccactttaacaattttcttagtgattattgtgttagccagtttctttggtgctcacttggcctacaaataccaatcttttttctggcgagaaaatcaaatcaaaatgattggcggcaaatacgcgattagtttaatgattatgaatgtcatcgtgatgctgctgattaatttccatggttgggtaaaccctgaaagttatgagacttggtcatatacattaacctatgcaatcacttcggcaattgttaaggggttgttaattggccaatcggttaatatgtggtggcatttgaaggtattgcctaagaagctgtaaccgttagttgatcataattaacacaaaaatgagctgtgtcctcgaagataacagaaagaattcgaggacacaactcattttttgtttgataggcttcggatttggagacctatcttggtaaaagtcggcaatctcaagagggaaaagaaagtcagtcaaccaaaatctcattgaactgagaggtacttcttgaaagacatttcatctttacgcagacattcaacatgtctacaaagactacactccaagcatcgcaattggtaatacatgtacccgatcctgccgtgtatatgcaaactgactagtattcaaaagaaccttggtcacgtcaaattcactcttgaccaaatcttcaaaccaattcaagtgacgaacatagtcgtctttggcttccggatccgccttaacttcaaataaaatgagggatttacctttctgcaaaatgaagtcaacttctcgagtcccttggtgatttctaaattgagataagttagcatcattagcgtccgcgtatactactaaactttggtaaaccaaagattccaataattggccaagtaacgtttgattgaatttgccaacatattttggaacctgataagtttctaactgctcacgatttactcccaacaatttaagagccatagcaggatcgagcatatagtgctttggcgcctttgctaaattagaatagattttaccgacagctaaaaatggaggtacttcgtcaataatatatagaatttccaaggcttctcgatagttcattgccgttggcttactcggagcttcaccactatttgccattgctgcgttaataattgtctgaaactttgtcgttgttccgattgaggctgagtaagctttcaaccacgccagcaaactttcaggtttttgtattttaaacccattttcttcaaagtcatgctcagcaatattatcaatgtagctttgtaataataagtctcgggcatgtggtgctttcaagcgaataccaggaaaacctgatttgaatatttcatccaagtaatcgttaatattattctgagtttgcccagaaatcttgccttctttggacaactcaaacaaacgctgaatggaaatatattgtttagacatcccccgttcttcaatcgtatacggccgtaacttcattcttatgattcggcctgcaccactatggattcgtgaattaacacgaatactacttcctgtgaaaagaacactaccatttggtaatccactgtcaacttgatgacgaacaaaggaccaaagctctggggcaagctgccactcatctaataagactggcttttcatccctcaatataacatctggatctccctttaacatcaatctcattgtttcattgtctagactgtagattgtttttgctaattgtaaacaagtttcagtttttccaactgctttggctccctctactaaaattgcaggaagctccatcagatttcgctttaatggttcatcaataattcttttttcatacaccactaatcacccaccttggcatttagaaggattatattttatcttttttgaacgctatattttaccaaaatcatatcttatattttaccattttgcaaccatccgttttacttttttgagagatatatttgactattttgcaagcaaatttttcagtgttggattttataagattttttcgcttgtattgacgctcagctatgtacataaagacaacaaaaagccgcctctcagcgactttctttgatagactcaattcttgacttcagaagaataaccaagtgaaaagggatgccggcaattggacatgcttttcttcattttgtaattaatgcttgtacaaccaagtataacttttaaatgagtatgagaacgcattcttcatcccactgccccaatggtaaacatccactggagattaagtcgttctcctctggtaaaatggccgacatcctactgagtacagaacttctaaatcctactacagggatcaatccttttttctggagtaggcatattctgctgtaatatggcacaacaatttaaaactcagataagccgattacacaagtcaccatatgcttgtacaataactcccggagcctccgagaccacttgagtgttaattctcaaattaaataaagcctggttttcaccgatactatttgctaaaacattgattgctttcccagtggctttatcgacatcacctagcggattgacaacgttccaggtactgccagaaccataaatcatagtttcatattcgtagcccgccggtattggactcatgctgataattgttttccccgctggataagtcaatttagtgatccccacttgaccaattccttgtttatcaccgctagaattattcatcgactgaaatagtgcattcctttctttaagttgctgctgcttttttaaggccttagcatctgcggtcttaatacgctgttcgatctcttccctggctgcctgtcgttcttgttcttcttggtgcgcttccagtaatttataaaattgttcataatgacttatcgtctcattcaacaagggcaagaattcattagtgataaatgtgacatcttctgcggtattagcatacatttttaaatcagatttaagtcctgtaacgtcaacctgaacataggtttctttggaattcgtttgaagtaaagtgtgggcgtcaacatacttaaaccaatcatatggcttgccttcgtatgctgaaaacgcaaagaagttggtaatcacatatgtatcgtcacgtaataaccgatgatgctgatttacatagactcccaaaacacggtactgatcatagaaattatcaatcttttgaaatgtttcaaattcagcattactataatccaatatgtttttcttctttgcaatgaccttattcatcagtgtcctagctattcccaaagctttattttcatcttccatattagtcacaatcgccatcatatccatctccattctgtccaaaacatccacttaactaacgattacctggacgcttaatcaaaattggtgaccattttcaatacacaaacttatcaacctgtgagccccagtcccctgttacgtacttcattttggtaaagtaacaccaagtccgaaatggtggaattctgtctatgccaccccgatgatttgtgtggtcaaagtattccaatccccaataccgtttatgattagctagaacgaagtgtcggggcctgactgtctcaactttaagcaggtcagcttctccttgtggtccgaaagtatatgcgcccttcacatttgccggtcggatgaaataaccatcattcacaaaatcttgccgataccagtatcgactgccaaccctacggctgtattcgtaaaccgaatgcatcgtaaaatgtaatttataatagtacttaccgccaaatgggccagtgtgggttgaataccaattgtgagcccgcaatattttaggattggtgtaaattttcgcagccgcaggaatggttttgccgacacttcccattaggctaattcctgtggaaatgcataatagtgtacaaagctttttaaaatccattgttaccctccattttcattgaaagttatcttgttttcgtgcgcccctagcaaatctgactacctcgctaaaaccgtcatcggctcatatttttttcaaaagacagatgctctttaaattgaaatcgatgctgattcacataatatcttcctttatcacatccgccaaacctgccatgaagacttccactgtattgcatgcttcgtaaggcctactcctgtaatttagcaatatcctctgacaaagtatcaccaaaactcgacgccgcactcgttgcttcctcactaagttctaatcccccatcatactgatcatcgtcatcagaactaccgtcatccgccagcgatttattaagtgcagtttgataattgtcataaagcgaatctaacttctctcgatcaaaagtgctaaatcgggacttgaacaagtcataaaactttcctagggtttgatagtcatttagggtctcatctcctatggtttcgtaaccaggatcatccttaaggtcatttccaatttggtaaacaatgctgctaatatccgagctggaagaaggatcgttatatgctgttcgaacgtcgacatcattcagtttctccaaatactcccctctagatatgggattcatcgtattaataataccaatcatggcactaatatccgatttctcttgatcataagtcttggctttaaccaaattcccatgccaagtccaaccatataccgttttggatttgttgaagacgtagtagtaaacggatttaacaccataggattttttaacggtcgttgccttattggtataaaaagtcgtgtggacataatttttgccgttatgaagacgaacttttagctttggcgaactgtaaagatacccgtgagtaatgttgtagggttgcgcatcatccatcgtttttgatgagacaattttgatgtgactcgccgcttgagcgtttgagccattaggagacacaaacatcccaatccccattgatgcggctaatagtccgacgtacgtcatttttgaatgtattgattttgtcattttttacccctccgaaaattgattgtttagttgatgcctttttattttcttgaatttatgccatgccaaccacgatccaagtctttataaacattcaagcgttcacgttaatgactcgtttgtgccagaaagaagtcgttcacaatcccgtaatgctttgtgaatatgtacttggaataacgcttaccccaatagcaaatgtggggcaaagttcgttgaaactttacttaatttcattacatccccccaacaaattatttatagttcaataatctcattttaatcctagtcgttaaccctgacaatggtcgcttctaaattccatcaagcttccttaaggtcactcctgaggggaattttaatatcaaatgaaattagtgtctgagtttattgcagactcttggattgaagtcaaccagtcggaagttctctaattttttgaaccagatgggtatgtaaccacaaaaaacaggtagcccaatttggctacctgtttaaaactgagttgttaagtttcggactctccctatacttctccctgaaatggaagttgagatctgaagatgaacaccccagccagtcgttattgcgtcccccaagagtggaactcggagcatgagggccaaaatcttatctaagctttcaaataccaatcgcaaatgccgaaattattgatatccaagcagtaaaaggcaacgcaacattttgtactttgaagcaattttcaagaactcatcatgattgttaaaacacatgcggtctagctaagttattcagttagattaggaatctcattgagctgagcgatgtttcctgaaaaacatttcagctttacgcaggcattcaacatgtctacaaagactacactccaccatacatttgttacaattagagatgttttgtgtgataatgctagtagaaattggtatgggtctatgagggatatgataactgttaggaggggctagctatggggttaactacgaagtggctctataaaagaatgctttttgtattttgtattatatttggtcttatgtcacttttttctgtttccacaaatgccaataatacagtccagaaatctaaaatagaaaatagtgataatttacgaactgtaaacaatcaaagtgactttccatcttataccattaataatggtgttttaactttgtatactggcactattactgaacgtcctagtaatggttatgcctggaactttgattctagtataactaaggtacagatcatgggtgaaattaaacttgatggtaattccacgtcaggtttgttttggggtatgagtggattaaaaaacattgtaggacttgaaaaacttgatactcagaatgcgactgacatgggatctatgtttcgtgaagattcctctttaaccactttagatatttccagcttaaaaactagtaacgttactacaatgggcgccatgttctggaaagattcgtctttaacaaacgtagatctagatggaatagatacatctagcgtgagagatatgggttctatgtttcgagactgcacttctttaagtgacttaaatttaacaagtttcaatacatctaatgtcatcataatgggagctatgttttggaatgaccttgccttgactaatataaatctctcaagctttaagaccagtgatgttgctgatatgggttatatgtttgcaggatgcgctaatctgaatagtttaaatctttctacttttgatactcggaaagctataagtaataaccattttacagacgtacatggggtaacacagcataataccgttgacgggatgctcatgggcctttctaatcttacagctctaaccttaggcagtcttaatcaatttgctcctcaaagttcgtacggcaacccaaagttgggtcctgcatatggacctgcaaattggcaagcagttgcagccgataaaggtggaactgtttcggttccgcaaggcacaaaatatacacctgacgatctaatttctcactataccaatgtcggcgtgccaaaagagacctatgttccagcagtggacgttcttcctgctccaattaccatcaattatgtaaagcaaagtgatcctaataatgttctaaaacaagtaacaatcccatccgatggacaaaaagtaaatgatccagattatcaatatgatgcatcgcagcctgaatatattcagccatttactacctctgatggcaagaaatttgacgtgattacagatccactgccatcaaactacaaaggtgaatttactgcagatcctcaaacagttacctacaatgtcaaacaggcagacgcgaaagatgttacgattcactactatgaaaagggcaccacgactccagttcagcctgacaaggttcttccaggggcaggtaaatatggagattcattcagcgtggataccaaagacttaaagccagctaccattggtaattatcaatacgattcaactagtgggacaaccagtggtcagtacaatgatgaagcacataccatcacattcttctatactcgccctgacgccaagacggtaacggttgaatacctcgatcaagatggcaaacctattcacgatccgcaaattattggtaaggatggcaaggttggcgatgaatatgatgcgactaccgacaaatataagctcaagacaatcactggttcggatggcgttgtttacagtttagacaccaacaaactaccaagtaatgcgaagggaacactgtccaaggacgcaattacggtcgtttatagatatgatacgaccaaggcagctccaatcaccatcaagtatgtggatgaaagtggcaatgtaatccacactggtaagacactgaatggtgttgttggcgaaaagtttgatgcacgttcagataaattgaacacgatcagctacggtggtaacacatacacgttagatactaagaaatcaactgctgatagtgctttacagggtagtttcagtgccgataaacagagcatcacctttgtttactcgaagaatgccacacctgttaatccaattaaccctgtaactccaataaatccaacgccgacaccgacacccaccccaactcctactcctcaaccacaaccaaacttgccaaattacgccgcaaccaaagggtctgccgtgtactccatcaatcatatttacctttacaagcatgccaatttcaataagcatgaccgtatcgcaaaatatgtcaagaaaccaagagtatatcgaccaatgtttgttgtgacgggttacgctcgatccaatgccggtaagttgcggtataaggtacgtgatgtcaatcatttgagcaagacggctggcaagactggctacattactgccaactggaaatatgtccgtccggtttattatcaaagtaaccataagactgtgacggttattaatccgcgtggtgtgaatgcctacaagaaatccaatttggctggcaaggtcaagaactacaagcaagggacaattcttcatgttaccaagtttgttcatcataacttgaccactcggtatgttctcagtaatggccagtacatcactggcaatcgtaagttggtaaatatgggcaagcatcatcaggctcattacatcaagactaagaaagcaattaaccgttataagactgttggtttacatggaaagaataagcactttaagaagggcgccaaaattaagattaaaaactatgatttttcacacgcacacaatgtgacaaaatcaggtagcttgagataccgagtcgctggtggttacattactggtaattccaggtacgcacagattgttaagtaaatagttccatcaaaaaggatcctcggcagtagttgtcgtggatcctttttggttgataaaatcggagttttatttgttacatctatagtcgtttcaaaagctgcttggtgacaaatggatgctaattaatttcaattatttttggaatcccagtactgaatggatttaaagccatttcattatgtacaacaacagtgattcttatggcaaaagcaacacaaatcactgttgtttagtttatagactcttgcaagatactatctcaaaaatgtgttccaaaccgcctattcatcaactctgtcagcatcttcgtcttggactctggcatccagattggccacgcttcttccactttaacgggattagtactgaaactgggtagtacaagcccatcacctacatttttgtatcttcagaacataaaaatcttttgttttaccattttgtaaccatctattttacttttttgacagatatatttaactattttgtatgcagattgctaagctatagtttttataagattctttcgattgttctggcgcacaattatgtagataaacaataacaaaaagccgccaatccctcagcaactttctttaccaaactcgattcaattcacttatgcgtcccccgagagtcgaactcggatcatgaggaccgaaatctcatgtgctatccattacactaaggacgccttacatcatttaattatagcgttttctgaatattaatacaacctgaatgttcatgaaaatttgcgggcgactttatcggcttgatcttccaggtaccacatcaactggttgccgtccttttcaaaatcagcttcaaacgactcaccgattggctgaatcgttgtcagcaacttttcgccaatcccaatgacttgaatctcttttccaaccaatttgccagtatcatagtggccttcctcggcctcatccaagtagccttgaaaagcgtcttcaatcacttgcttcatcagtccgtccctggtggtttccgggtgacgggctttttcgattgcaaatttatcttcaaattcatgcatgttttctggataatctagggacatgattgtacctccacattttctcttacaaccattataaagcaccaaaagcagaaaaaacacggatcttgtttatagaaatccccaaccggcacattctacttgcaattgatgcgccaatagtcgaacatataaggtgtgaagtgcttacatcatcctaatgggaggtaatataatgacacaagcgatcacggttgaagaatcacgtgaattagatgataaaacgattaacaaaatcggcatcccttccctcgtcttgatggaacgggctggcctcaaaatttatgaaaatatgctcgataacaaagatctcgacttaagcaacgttttgattcttgccggaaccggcaacaatggcggcgacggcttggttgttgcccggcttttagccactcatggctatcaagtttccatcttaacggttggtaatccggatcatgccagcgaagatcatctggcccaagcgcggatctgtaactactatcagattcccaaggtcttcatgaacgccgattttaacaaattcaccaccttggttgacgccctatttggcagcggcctatcccgcaacgttggcggcgacttcgccacgattatcgataaggctaacgcttcaacggccaaaattcacgccatcgatattccatccggcttgaacggcgacaccggcgacgtgatgggaactgccatcaaagccatctcaacttcaacggtggcttatccaaaggtcggcatgctcaaagatcaagctaaaccatacactggcaagatctatgtcgatgatatcggcatttatcgtggcaacgcatttgaaaatgaataaatattaatataatattaacttaactagaatcttctcagaatacgtggaggtgccgagatggctgataagaaaacacaaggctatatcaatgttcacgacgttgatccagacatcattgttgacctgaagtacgcaaccagcgataattttactcaccaagtggtttatgactttgaccaggcaatttctcgaattgatacggtcaagaagttggcaaaggccagtcgagacctgaagaatcaaggttaccgcatcaagatttgggatgcttatcgcccaacatacgcccagaagcgtctgtttgaggtctatccggacccaatttgggtagccgagccggatcctaacttcagccaccaaaagggcgtgacatttgacttaactttaaccgatgaaaacggtaacgacattgagatgcccaccggctttgacgattttgacgggctggccaagcgcagcatgaaatcatcatggacaccggctgcccaaaagaactacgatatccttaatgaagcgatggagaaagccggctttgagggatacgaaaatgagtggtgggacttccgcgattcggacaaggatcaatttggcccacttgaggtcgatccaaaggattattaaattcaatattaggagtatgtaaaatgaaagttggaattattggggcaggtccaaggggaattttattaacctctcaattgtttaatcaatataaatatcatagtgaccagaaatcaccgctatcgatcactttgtttggcccgtacggtatcggcggccgcgtttggcgaaccgaccaatcggatgaattaatcatgaacagttcagctgatcaaatcacgttatttaccgacgcttctgtaacgatgtccagcaaggtgtatgacggcccttctttgtttgaatgggccaagagcgttgaggccaaccgttatttggatagcaacggctattcatcagacgtgattgccgcggccgctcaactgcagatcaacggctatgcacctcgcgttttatttggtgcctatatcaaatggttctaccaagatttgattaaacaacagcctaccgaagtttcaacatcattaatgaagtcacaggtcatggatctcatttatgacgccgaccatcacccggtgatcaagaccaacgacggcacctttacctttgacaaggtcatcatgagtctcggccagcaagacaactacctcagcgatgaggaacaaaagttggccagctatgcccaacaaaacgccctgacttatattgcccccactcaccccggtgacgctgatcttagtgacattccagctggtgaacccgccattatccgcggcttggggctgagttttatcgattacatttctgaattgaccctggggcgtggcggccactacatgcaaaatgaagacggcagcctgttctaccaaccgtccggcagagagccgcgaatcattgccggctccggccgtgggattccatactaccccaagccaatcaacgaaaagggttacggcgagtgtgaagtacccaagtttttgaccaaggaaaatatccaaaaaaattcaactgatggtaaaattcccttcgataagttcatggaacttttactgttagatttaaagctggtcttctacaagttgaccatcaatgataaatacccatacaagagtgcctcgaagtttgaaaccgaatttttagccaacgacgataaacaagccgttctcaaacaatttggtttcgctgaagaagatgcctttgattgggattacatcatcaaccccttcaaggacgttcaagcagttgggaccgaagactatcagtcagtattgattaactggctaaacggcgaaattgacgactcactgaagggctcgaaaaccggtccgctggccgctgccagagacttactacgggacttccggccagcttttcgccaaatgctcgtcgatcactgcttcagtaatcaagacttggttgagaaattctggggtcaactcgactcaaccatcaacttcttaattatgggaccacctgtggttcgcagtaaggaattgtcggctctcatccggagtggcgtggtcacgattttggcacccggtatgcaggttaaaggacaagacggttggtttgtgaccgctgcccctaagcgcaacaccgatactttccgttcagctaccttaattgaggcccgggttcctaaagccgacctcgatatcaccgccaacccagtgctggaaagcctggttgacgccaagttggcaagaacccaccaggttaagattaatgatcaatctgtcggcctcaatgcggtcgacgtggatccaagtaccgaccagttgttggatgccaacggtgccggtcaacccgacatttacgtctggggcgtgccgttggatggcctacgctatgttaccaacgctgcgccacgaccaggcgtcaacgacactaatttgcagacggcagatcgtttggcagcagaagtgttggggcttccggcagctgggaatgttgaaatggcttaattgaaataaatgagattgtaaaacggacgccgtcagtggcgtccgtttttgtttaacgattaaaaagtctaataccaaataaacgagcagtatcaccgccagcactacgaaagaccaacttgatgttggggcgctggttaataagaataactgaaatcggaatcctgacgtgataaaaaccctttgaatcggttgactgattctgatcaacggtgaggacttgatcgaatttatgatcgtcgttaaagccaaccacaatggaatgccctgcgtcttcaacattcaaggtaagttccaaggacaaacctggttgagctttagctaacgaaaattggtagctgaaccaaccatcttggtgagcaactctgaagcgtcggcctttggcattgctggcctcggaacgatgctgctcgagatgtttatcaaattcaaaattgttctgatcaaaattatccagttgaccgactgtttttcgccgatattcgcttaacgcttgcaattgttcttcgcgacgctgagcctctttggagccggccagctgccactggaagtaaaccccatatcgaatttcaaaggtttgataataaggcacaaaagtgattgtttcactcgtattcggtagcttcaactcgaatagtgtattcgtcgtctcggtatcgacaacggcttgactgttcaatgactgctgccagtcgtgccaatccataccggtggtcaatgttgatgggaccgcctgatcatgggtgctgatccgcaccaacacaccatttgggcgatcatcattgatatgatgcttccccagctggcccgcaagaacataaggaccatacttgaaggctacataatgcgggttatcctttgtctgcaccattttcaaactcatcggaatctccaagtcaacggttgttcctgtgccggcgttatcgatttcccaaaaatcagcattttgatccacctgctgagaaatgccatcgactgccaattttgccgactggaccaaccaggcagggtttctcaacttcaaattgattgccccagcactatcttgtgagcgtaatttggcgaccgttaagtgaaccttgccggtttttcgatcgacctgttcagtcatctggaggttatttgaatcaagccgtaaaacatttgagaagtacaaactcagatacagctgatctccggacatgaagtcataactgtcgcccaacttagtgaagttttcgatgccagtacccgtacagcaccaaaattcatcgaatggccggttatacaccttggtatagcctgctgccatcggctggaaataggtcatcatcccagtgtttggattctgtgaacccaagatggcgttggtataggtctgctcataataatctaaatattttttatcgccggtgactcgaaataactcccggctcaatttcagcatattataagtattgcaggtttcacacgttgttgctccgtcctccaatactgcatcatgaaacagctggccgggttcgtggaaatgctcactttggctattcccgccagtcacataggtatgatcatcgaccacgatttgccagaagttaaccgctgctttcagatacatattgagtgaccctttttcttcaggacttaaatattggtcggcccgcttcacgtcatgaagggattcatagcggtgtaaagcgccaatcaacttgggaatcgtcgtgttggcgtgttttccagccaggacatcgtcaccctcagctagctgtttaaataatgcggtttcgtcaaagtaagtcgccgccgtcagcatgcgtttatcatcagtcaaatcaaacaattcatacagtgcatcgttcatcccaccatactcaatcttgagcatttgagtggggtcagccagttgattgaggcgcttaaagacataaatgccaaattgatgggcaattttcagggccttctcagacagaagtggatcaattccttgaaggttgaccttgaccgccaacagccctgccaggaccttatgcaggttgtaccatggcaccaacacattctctttctcatctttgggaacttccctgccctctacctcatccagggccacttctctgaacgctgagacatacccagcactatcaggatgactttttgcataggcggcttgggcagactggaggccatttacgcccaggcgaagtttgtcgagcaattgctgccggatgtcgttcacttctgtagcgagaatcgcttgggaaagtgccgacagataatggccgaaaaaatggccacgaaaattcaaaccatcggtgcgctcccaaccttggtagccggttacgccacctgagtcgatgccagcaacttcatcaaaagttaccaagaatctttttggatccaacgctaataaatacttaacagtcatctgctgggcatgctcaatttctggatcagttaatgtaagaaatctttgatcaatgctttgtttcatatctcaagccaccttagtttcttaattgttcagtcaatagaacatcgtgactaccaatttgaaccgatgctgctgccaactgtctgtcatgccacacatcacgggcgtcattttcaattccaatttgttccaactgcacttggctaaccataatcggcttggacgatatgttgaaaataccatagtaagcataacgatcactatgagcataccaaacaatcatttgatcggttctggttaattcaaatttttcggaaattgaattgtccattttcaaaagggttgaatttgtcaataaactctttgtccaatcatccagatccgttaactcgccacccataatgagtggtgactgcattaatgaccaaagactcatcatcgtccgctgttcggcgtgagtgaagcgggtttgacgattacctcccggtccatccactgaacggatgccaatatgtcccaaaggcagcatatcgcaatctggccaattgccaggacgggaaattggcgcccactcttccgcacggtcaaacatattatataaaagcggccattcatcccaaaaatcatttgtaatgcgccacatattggcgttccgctgaaagaacgaaccgtttttaattggtgccggtccgggcgataacgaaagaacgatttggcgtcccgtctgagcaattgcttttcttaaggcgacgacctcatctttgtgcgttttatcatagagctgtgagttggcaatatcatcgcatttgacaaagtcaactccccaagaggcatataaatccatcaatgagttgtaataaagttgaccctcgggtatagccatattgaccccatacatatcagaattccaaggacaaatattattcctggcgatctccctggctgacttgtcggatcccttgatggcggttgcttgatggaccgcttgacgtggaatgccccgcataatatgaatgccgaattttaatccaagactgtgcacgtaatcggccagcggtttgaatcctcgaccgcccgatgcagatggaaaccggcccggatcaggcaataatctggaataatcgtccatgatcaaaggataaaaatcatgatagcgagacgaattggcggtcggttcataccactgaatgtcgacgacgatatactcccaccctaattgcttcaggtgcttactcatatactcagcattttttctgacctcttcttctctaaccgaggccccgtaaccatcccaactattccagccttttggtgggacaggcgcgaatgtacgatgatgattaattaacatgtgttgtttcctttctgctactgggttctaaattgctttgtgctcattaacacactaaccgaataaggcggcaaaatgaattgatgtccagaaaatggtacatttcgccgttcaatttgattagtcattccaaggtgattttctgcatctggcaggccggttaactgatacaaagacccgtcagcaaaaagatctgtatcaagtgtaatttcttgctgcttatcagtcacatttaccgccttgaagtaatattgactggcttttttatcgtatgtcagatttgtgtacattggttgaacgacaaagggtgggatctcaatttcgttcattttttcgccatcaatccatgtggtgatatgacgaccggaaaccttgatctgacagtgataggtttgattcttattcattgtccatgatgtctgggtccaatcagtgtccattccattggtcattgttctaatcatggaatcggtattgccccagcctccaagaacccaggtaaacgtgttatccaagtcttgttcaccaaaacagaaatgggcacctttgggttcatctcctaccttggtgacatcaaaggccacttcatagtcatctgcatccgtagagccaaccctaatggtctgtttctcacttagagattgacccttaaactgctttgtctgaccattggctgttagtctgatattttcaaacttaacatctgtgccatctgcttggggacttaggccatcgttgagcgggccgtcatcaatcacttttgcttccggaacgttagctaaatgataatcaacattgtttgttccctgatacttcatgaagagctgttgaacgtagtaattaactgacggtgaaacttcgctttgattaaagaaaataaggtctggtgtccagtccttataatcgacattgcagaacaaaggtgcataacaggctaatccaaccttatcagcatttcgttctaagcctgtcatatagctcgcttcaaccacggcattgtaccactggtttttctttgaagcatattcaccaatgaatgcttttggccccttgggatcataagaatcgtaccgatgctgattggctaagaaccaggtcggcgcagtgtagtaatgttcatcaaccaaatcagaatgattctcccgagctgacttccagccgcgttcaaattcagcacccgcggcaaatggacctgaagtattaatcaatttaatattaggatatttggctttaatggctttatggaagtatggataacggtcaaagaaggcttggccgacttcttcatttccaatggccaagtatttcaagttaaagggttttggatgtccaagcgctactcgaactttgccccatttactattttcggaaccattagcaaactcgattaagtccagcgcatcgtcaatccaatcacctaattgagcaatcggtgcttcccgatcatgatgcggatcgtgagcgcctggtaaaacaggtagcggttcagccccgatatcctcactcagctcaaaatattcaaagtatccaaggccaagtgtctgattataaccccagttattccggcgagctgggcgttgctcaaccggtccgattgagttcttccaacgatacatcgcaccacggttgtcaggatccagttgaccgtcgtgaactaaacaaccgccaggaaatctcaaaaacttgggatgcagatccttaagggtttcacctaagtccgcacgaacataatttggtcgatgattgaacgtattttttggaaataacgaaatcatgtcaaccaaaatccgcgtcccctctggaaatgttagcaccagtcggccagttgttgtggtctgctcggctgtgaactgagcggaatatttcaaccactggtgactttcaaccgtgattgactgaggggcggcgattttcttacctgagtcatcagttaactggacagtcacttcttgagtcccgtttaaggctttcacaaagaatgaaaaattatattgttctccttgttgatagaacatgcctgaattaaaaccagcattggtgatcgtggctgtctgcttagcatcgacagttagataatgaagatttttggtattcaaaggatccttatcggcaactcgtaaactttgcgggtcactgagttcccatgcagtggttgcctgatagtcggaattatcaatgggggcaaactcaaatgagcgattctgaaccatttcagcatatagtccaccatcagcagcatggttgatatcttcaaaaaagataccaaataaatcattcaaaggtgccgttagttcgttagtaacggttaattttgtgtctttcaaagaaattctccttccaattgcgtgatacagaaaaaggatgaacactcgtacatattcatccttttcaatgccacattttccttatttaacagatttaattctgaagattaagatggcaccaactaattcaatcaggaatgaagccgggaagattgccttataaccaccaagataggtaacaatcaacgaagcaacgacggttcctgaaatctgtgacaaggtatttgccaagttaatgaagcccatatctttacccgaagtctcggcattcggcaaaacagccaggttcaacgcaccatcaacggcattataaaccccattaccaatagcagccaagacagcgtatgtcaaaatggtccatggcttagcagcaaagaatgggaagaattgtgcaataccaattaacagtgttgaaagtgcaactggtgcctttagtcgacccactttatcagcgattggcccagaaatcgcggtgaagacaaccccaaagatcaggttgatagaagcaatttcagccaatgtcttaccggctgtctgctgacctaaatgcatatagtcagtcaaaatgtaaagcatgtaagccgtggcaattgtgccacccataaccatcattaacttaccagcaacagcataccagtaatcacgggcacctttagttggtaatgagaagtgaagccaaagtgaactccacgagaatttctcccgtggctcgtccaagttgctgccttcattggcgaaaagaacatggataatgcccattacaaaaccaattccggccatgacgtacataccttccttaggcttaccaagaaattgagcagcgatcatggcaaccaattgaatggcagtatagccaatgccataaagggttgaaattgttcctcgccatcggggtgcaattcggtcggcttcttgagcaaccattgcggcagcaacagcattttctgcggcagcaacaatcccccaaaggacaacaatcaaccaaatcgacttgatattggcaacaatacaaatcaaccctgattcaacaatcgttccgccaaggatccaaggtttacgttttccccaacgggtacgggtaatatctgataagccaccaaataaaatgttagcaaccgcggcaacaattgatgagactgatgctaatagtgcaactaaggcaaccttttcgtttggtgcaatttgactaaagtattgtggtaataacgtgttacgaacgttaccagctggtgccagccaaacaaacggcccgatcagcattgccaacccaaacagtttcgggaactttggctgttcagcgttggtcactttggcgttggttggttctggcgccggttcaactgcctttaaatctttttcatctttctttgacatctttaaaccccctatgggaataaattttattttattgaagcgttttcatttcaagcgcaaaatagaatcattcaatcctatttcaatgtgacggtgaccacactctttgacggcaaagctaattgcaattgatgctcattcaaacgagcagccttaaaatcagcttcaaccacgttatctggattttcaaaggtattgtgagcatccagtgtaccagccgttagaatcttggctgacgtcacttctttcaagtcggccaaaccagtgaactcaacggtctggttctcatgggcatcatagttacaaatggaaatcgttaactcgccgttttttcgtgaagcggtgtaagtaacattttcaggcacatcaccaaccccttcaaccaattcagcattcatgtgcttttgatacatatcaaaaacataataggtcggcgtcttcagcatctgatcacccttggttaaaatcatggcttgtaacacattgaccatctgagcgatatttgccatataaacccgatccgcgtgcttttgaaaaatatttaaattaattgctgcaaccattgcgtcgcgaatcgtgttttgctgatgcagaaatcctgggttagtgcccttttcaacgttgaaccaggtgccccactcatcaacaattaagttgacccgtttatcaggatcataccgatccatgatggtggaatgcttggtgatcaattcatccatgtgtttggcacgggtcattgtcgaatcccattcagattctgggaaaccggtggcgtcacctttgctttgaccccaggtccccttcggcaaagtgtaataatgaagactaatgccatccaaatattgaccagcgtacttcatcaccgtatccgtccagttataatcgtcttcatttggaccgcaggcaactttgtaaattggatgatccttgtcatactgaggcaaaaacgtttggtactgacgataaacgtctgagtaatattcaggacgcatattgccgccgccaccccatgattcattaccaattccaaagaatttaactttccaaggatccttttgaccattttgtcggcggaggttggccatcggtgattcacccggcatggtcatatactcaacccactcagccatttcttgaaccgtcccgctgccaatattggcattgatataggcatcagcacctaattggttcagcagttcaaaatactcatgagtcccaaagtggttattttcagtgacatcaccccagttggtgttgacgatctttttacgatcatccataggtccaataccgtccatccagtgataggtgtcagcaaacaacccacctggccatctcaatacaggaacgtgaattttcttgagggcatccacgacgtcggtccgcataccgttgacgtttgcaacatcagaatttttgccaacatagagactgccatagatcccatttcctaaatgctcagaaaattggccataaatatatttgctgatttgtggaccagacttctgaggtagaagttcaattgtcatattgttcaacctttcatgatttgctacttcttattaacataaatgttaatattcaagtggtggaaattgttaatgtttaccggtaaaagttttaacgcttttaatatagcgcttacaaatcccaatgtaaacaagtttttactaaaatgttgaatattttttcctatttagtataatgattaagaacgagttgctaaggagcttcattgagcttaagatagtaatataaatgttaacaagaattagaggtaatcatatggaccttgatatttcaaataagtcgctgcccatttttgctgctttggacagtcaggtcagaatcaaaatcatccgtttactttcagaaaaaaagatgaacgtctcacaaatttctaaggcaattcgcttgagcagcccaattaccctcatgcacttgaagaagctggaagacgcccacatcatcaagacgcaaaagaagggcaaccaacggatttgcagtctccagatcgatacaatcaacgtcagctttccgcaacaactctatattccttatgagaattgggatattgagctgccaattgggcaattcaccaattttgatgttcagccctcttgtggcttggcgggtcaaaagggcttcatcggcaaagtcgataaccccagttatttcatggaccccaaacgttatgaagctgggatgctttggtttgccaagggatacgttgagtaccaggtgccaaactacttgaagcctgaccaggaactggaaatgatcgagttgtcgatggagttaagctctgaatttccattttcaaacaaccgctggccgtctgatattaccattagtctggatggcaaagagattggcacgtggaccagtcccggtgacttctctgatattcgtgggcgctacacgccggattgggtgtataacgacatgaatcaatatggcatgctcaagtccctgcgtgtttccaaacacggctcgtttatcgacggccagcattctgcggatacgacgattaatgaattagacaccaccaagaattcgtggacgctgcggattggggttaaagataacgccaagcatgctggtggttgtactatttttggcaatcaatttgggaatcatgatcaggggattaagggtcggttttattttagtgaaaattgacgatgatcgttatcacagcttttttcaattctctgaatttgttttgaggacggcgactgacccccagatccctccgcttaaaaaagtaatcgggtgcaatgcgcaaagtacgcgcattacacccgattacttccaacttcgcctgcggggtggctaacttgttcttgcaatttccgatggataaaaaattgaaagtttcagctttgtttctggtggccgctacgatgttggcaggctgcgggagtaaaagtgcaagtgcaggaacccatgattatgcgactaaacaaagttataatttgatggctagtactgaggtggaaacgatggatccgtccctcgcggatgactctacctcactgacacaaatagaaaatacaaatgaaggactttaccatcccaataaagccggtaagttggttgctgaagcggccaccaaaacaaaggttagcaaggatggcatgacgtatgcatttacaatacataaagggatgaagtggagcaatggcgatcccgtcaccgcacaaaacttcgtctatggttggcaaagaagtgttaatccaaaaacgaaggccccaaatgcctttctgtttgtgccaatcaagaatgctgatgcaattacagcaggcaaaaagaatcccaaaactttgggtgtcaaagcaatcaacaagacaactttcaaagttactttagttaaaccagcaccatatttgaaacagatgacggcactacctgctttttacccccaggataaaaaggcggtcgaaaagtatggtaaatcttatgggacttccagtacaaccacagtttacaatgggccctttgttcaaaaagggtggacgggtagcaatttaacttggaaactgaagaaaaataaaaaatactgggataaaaaatctgttcatttgaccacggttaacatgcaggttgttcaaaattccagcacggcattgaatttgtatcaagttaagaagttggatgacatttctttgtcaggtgagcaagccactcaagaaaagaataataaagatttttattcaacactggcaaattccatgtcctatgcagtttacaactttaagaataaggcaatgcaaaatatcaatattcgaaaagcaatctcgcttgtgctgaatcgtaaacaggttaccagcaaggttcttgccgatggttctattacccctaaaggttttgtaccatctaaattgactgaaaatccaaagactggcaaggattttgcaactgatgcagcagttgccaattcggttactcaaaacaagaagcttgccaaaaagtattgggctaaaggaatgaaacaacttggaaaaactaaattgacgatcaatttgatgtgctgggatgaaggatccaattcacaggttgctgaatatatgcaaagtgaaatcaatcaaactctgaaaggtgcggatgtgaaagaaactaccttgccaaagaaatcagcaatcacaaagatgtcgagtcataaagggtttgacatggcgttgaccggttggagtccagattttcttgatttgatggatgttttgcagcttgaacaaactggaaatccttataactttggatcatttagtaataagagttttgataaggatatgaaggctgccattacaaccgatgcaactaatagtcaagctcgttatgatgattatgtaaaggctgaaaagatattgatgaaacaacaaggtgtagccatgattgatcagggagcttcaacattcttgcataatcctaaggtaaaggatgccgcaacaaccactgacggtggcactttcttgaagggtgcttatgttgttaaataatttaatctaagatttaaaacacagaaaaatctctgaatttcaacagtaaaaactatgactgttacgaattttttggagatttttttgtttccagaaatttatttaggtattatcacatggctgtgctagactttaaaaggataagtagttactgaaaagggagtttataaattatgacttttgatggaattgttgaaaatcttttgtctgaaatcaaaatgcggacgcatccacgtactgatggcattaaatatcagtttagagaatgcacatttcctgtgacatttacgcgtgatgggtacaaagaagcggatggttgtgcaatctttttgatggagccggacggtaaatataccgtgaaaaagtttggtactcggtatatggatgtggatgatccaatccgaggtatttatcacggtgctatttttgattgtgaggaagagcctgataaaatggatgccctcattgaagctgtggaaaaagggactcctgaaattaaataagcttttctgtggcgatttaaagctctttaacttttctagataggtaagtaacgcagaaaagttgttgagcttttttgtttcgtgaaagcgctgcaatttggtgctaaaatgaggtgtaccaataagtaaattaaagttttgaagggaagcctcacaatggcagaatcaactcaattaattttaaatgcaatcaagcaaacaacggacgaatggcgagcaaatgatcaaaaaagggatgctggactacccactcaatttcctgatgtgacgcggtacgacaatctgagctatggtcccgccggtgtggagaacctgttggatgtttacacaccaaaaggcattacggaaaatgtgcctgttattattgatattcatggtggtggaaatgtctacggatctaaagaactgtaccaacactattgtttgggatgggcacgagcaggcttcggcgtagtgaactttaattatcgtttggcacctaacaccccatttccaggagcactccgagatacagctttaattggcaaatgggtttctgaacacggtgaagcctatcatttggatacgaataacgtatttattattggtgatagtgcaggcggtacgctggccgaacaatatttaacggcgtattcaaatgaagattatcgaaaatccttaggcttagcagatagtggcaagctccaaattctgggtggctgtttgaatagtggcttttatttcattaaacgcgctggggcggtgcctgaaaatagcatgatgagtgcctattacacgccggcagtgttaaagaaatatgatcgggagctgcatacggaaaactttgtgaccgaaaaattcccatctgtatttgttatgaccgcaaatcatgattttttgcatgatgaaggaattcggtttgatcaatttttgattgaccgggggattacccatgaatttcgggtttatggtactgaagaagaacctagggaacatgtttttcagttgaatcagcgggataatgtggcggcgaaagctaaccatgctcaggcagaattcttgcgtagcttagtaaaaaaataaatcagaatgaaatttttctgttatttcgaaagtgaattaagctcaaataagagtatttttattcgtattaatgctagtttggcagtcttttttcaaaattatcgacttaggtttgaagattattactgaataaaaaaagaaactgaccatttttaatgaataaagtggttagtttccttttatataaacggaaattttattcagcaagaacttggaaaaataaaactgagccccatggctgacctttgattaagctcttagcttcttttgcggcagctgctgagtcatctggggtgactttgaattcaagcttcatacctgttttcttaacgaattcgtatttgaaatcgccatcggattcagttaaaagtttggtaatatcgtcttgtttctgtggtgaattgattgcaatcatatttttctctccttgtattatgtcaaattttgtttcctagacacataaattctattataaataacagaaaaagtaaaccctttcaagcttgttgaactgggaacatagacgtagtgttctaaggtagtcagttggtcaaaagttaggcgatttgtgcttgaaaaagtgagtttttgataaatattgataagtcgcttgtaatcgatttaaatttcgggtaacgtgaaaacataaacattgctgaaacagaaaggaaattctatatggctgatagtgaaatatttgggaaaaaacgtgctgattatttaaaatttaatggcaattatgcagcaggaacttttttagataataatgttcaaaaatcaaattatactaaagttgcccttgtgccaacgatcgataccattaactcatggtcgaaactatataagcaatttaaacttggtgaagactattcaaatgaccaatattggcaagataaatcgaagtatttgtccgatgtgacccaggcaaaagagtggttggaagaattattcaaggatgcgtttaaaatcacagcgattggcgccgaatttttggagagtgtcggtaaccgttcgtcagaaaactcggttcaactgacagaagcgactgacatggataataattgttattacattttgcagagtggttttccagcgcttgaagccaagagtaatgccatgaaacagtccccagattttgcgtatgatcgtgatgtatttaatgttgatgaccagcgaaatatttcctttgatgagcgcaacatggatctgttaatcatggcaatggtcaaagattattttgatcgcgacattacgccacaagagttggtctccaaactgcccgcgtttcgagtttgtggtacgtttaatgattatggtcgcccagcttctgatggcaatcggctgtgcacaatcatcaaaacgagtcacaagaatgatttaaatcaagcttctgacgaaactcaattggcagcattgaaagctggtaagccattagcagtcgacgttgatcgcagtgcggcctggaaagcaaacgaaaagaaacgtttggaatggttgttggctggcgaacctgcagcgcaagttgaaaaatagcaaataatgaggccccaacaaaaattgtttttgttggggcctcgtttatatttcctgaatattatttccaagacgttctttttatttcagacgactaatttgatgaaggacttgctgatgaagcatggtattggggtttagtcctggttgatcgtttggcactgataaagcgagtttggaataataatctaaccaatagggcaaaacagccccagtcgtttggtcagaaaaattcatgggaatcagtttgaaaatttggttgtttgcaaaggcatagtatatgaaatcagcacagtagtagccttgctcaccaggaatatagctggcattataaggttgattcaaaagttgtttggcttgttgaatgatttgtggcgcgttgattttttgattggcacgaaacaagtcgatgtgagcccaatttcgagttttaaaagtggaataaggctcacggatgctgccagttgaaggcaaggtgtggagaatgaaaatttggttgtcagttgttacttcaaccagcgcaacgtgatcataaatatcacttgttaaagatacagtgctatctacaatggcctgagaaagctcatcgggaatactttgtagaaagagtaggtcagcatttttaaacatgatgttctccttgttgattcttgcgggtaaggttgaattgtaattcttttcttttaacgatttaatcttttagatttccacaaccggaatcgaaccagagccagtcaccagagtggaaagcagaactagatacgtttaacgtttccgcgccatacccaacctttagcactgccatgtttggagtgtacatagtaataaattgcgccactttcaattttttcgtgcccagttgcaatccaaattgttctgggataattctttaggtaatgtagctttttaccaccaggcttggaataaatccaagcattactagtttttcgtttggtgttaaataatttcattgacttgttccaaattacaaaattacggctatattttgtgcaccagttagcattagtttggggaacaatgaaaaaagtgcggctattatggtaatattttccggatttaactatatagcccccggtactcattaaatatccagatctataaaatgctgtacctcgtttgatggtgccatagttgtaggcgatgttttttgcttcataagtgccagtctttactttataaactttaacggtctttttagcaataacatgtgtttttgcttctttagcataagagttaccgcttaaatattttgatgcttgcgcgttagtaggaaacaacactacaaagactaatgctaatagcaaagccaaactaatatttctttttttcattcttaactcctccagagagtataacaatttatccataatttaaatggactagtgaatttcatggatatcaattaattgctccacaaataagtataacaaaagcaaagcgtaatgttagatgaagtacggtttaatttgaacaattatgtgtaaagggtctttagagatagtaaccaacctagttatgtaaagcagatatctttggtacgacatttagtcagtaattctgggacaagttacattcattttggtttagggcctacttgatgtttttagaaatatccgacttatgctagtggagaggttgacgcaaagagtgtatcgatgcgacttggcgatttatctctgtagcgccccacactcttgtgccaacgtcgcaacgaaacaaaatataaaaccattgccaagtaaagtttcaatctgacatttgcagaatccaggttgacatccgccaagtttaagactattgtaatcacaacacaaaagacctttaacttagtccgagagaccaagaaggattccgatgaaagtaacaggaagatcccttggctgaacgactaagggatcttttttaaaattaaataatgtcactgaaccatttaaatgtttcctgagagaacaaaacggtgcagtaaagtctttgcaaaaaaacttttcgcaaggggtctacacgcaaccagctagtgcacttagttaatcagaaaacgattaactaagtgctttttttgtgaaatgaaagggagaaacaccatggcagaacaaatacaagcaaatttagtttcaatcgatcagttaaccgcagatgaggccgtagatttaattcatgaagctcaagattttaaagctggtaaacaggtacagttactaaagccagcgtatgcgatgaatttattttttgaagattccaccagaaccaaaaccagttttcaaatggcggagaaaaaactagggatgcaggtcttggacttcaacgccgcaacgagttctgtaaataagggtgaaagtttatatgacaccttgcgaacaattgaagaaattggcgtcaacattgcggtgattcgccatcccaaaaatgagtattatcaagatttagttgagaatcctaacttgaaaattggaattgccaatgccggcgatggttccgggcaacacccttcccagtgtttgttggatatgatgaccattcaggagcaatttgggcacgttaaaggtttaaaagtgttgatcaatggggacattttccattctcgagtagcaagatccaatgcagaaatgctttcccgattaggcgccgtggtttacttttccggtcctgaaaagtggtttgatgcgaagctagaaagatatggaaagtttggtgactttgaagaacttttacctcacatggatgtgattaacatcttgagagtgcaacatgaacggctttcaggaagcgcaaatagtgattttgacgagcacacctatcgcgacaagtttggcattaccgcaagccgcattcagaaaatgaaatctgatgccattattttacatccggccccagttaatcggggtgttgaaattgatgatgacttagttgaaagtccccattcaaaaatttttacccaaatgaaaaatggggtgtttgttcgaatggccattttaagtagtatcttgcgctaccaaaaacttttgtaggagctgagttgggatgacactgttattaaaaaatggatttgggttgatcgattataagttgcaaccgctcacagttttgattgcaaataaccacattcaagaacttaacggctcgacaaccgaagcagatgaagtgattgagttacatcaagattttatttctcctggtttgattgaccttcatgtgcacttacgcgaacccggttttaccaataaagagaccgttaaaacgggtgggatggcggctttacatgggggcttcacgacaattggagcgatggcaaatctgaatccaactccagatactgaagaacgtttcaaacggcaattagaacttaacaggcaaaccccaatcaaaattaaacagtatgcgcccgttaccaaaaatcgtgcaggccagtttgtagtcaattttggtcaactggcaaaggccggggcattcgcatttagcgacgatggctctggaatcgaaaatgcccacataatgctggaagcgatgcgagaacttgccaaactacatttgccattatgtgatcatgcgcaggatatggctttgacaaatggcggtgtcctaaacgcggggatgactgctgaaaggttgggcgtacctggagtgaataatgttagcgaagctgtgcaaatcgcccgtaatttggttttagcggctaatacaggtgtgcattatcatgtttgtcatgtgtccactaaggaaagtatcaatttgattcggcttgctaaagcgcaaggtgtgaacgttacctgtgaagtgaccccacatcaccttttgttagacgattccatgattgttggtgatgaaaaatcgcagtttaaaatgaatccgccgctgcgaagtccagaagatcgcttagcttgtgtggccggattgatagatggcacgattgatatgattgctacggatcacgccccacatacagatgccgagaaaaaacaaggaattttggcatcacccaacggaattgtcggatcagaaacggcctttgcgttgttatatacgaaatttgtcaaaactggtctttggccgctggataacttaatcgattggatgagcggggcaccaaaacggctgtttcacttaaacgaagcgggacaacttaaagttgggtctttggccgacattgcggtctttgatttaactcaggaaaaaataattgaggctaaaaatttcttgtcgaagggacataattcacctttccttggtgaaaaagttttcggaaccacagttttgacagtagtggatggaaaagtgacatatcggaggaagccaaataatgactaaaaaaagatatttagtattagcagatggcggtatttacgaaggaaatgcgtttggtggcgaagtcagctgcactggtgaactggtttttaatacagggatgactggctatcaagaatctatcaccgatcagtcttataacggtgagatcctcatgtttacatacccgttaatcggaaattatggcatcaattttgatgatgatgaatcagtcacaccaagaacagcgggggtggtcgtccatgagttagcacgcaaagttagtaattggcgcagtcaaatgaacctggatgaatttctgaaacagcatcaaattcccggcatctctgggatcgatacaagagagttaaccaaaattgtgagagcacaaggcaccatgaaagcggcactggtcaacactgtggaagaagcgcaggactttattcacggtggtttgaaaacaacaccgataaacttggttgaacaaagtacgacgcaaaacgcgtacccgaaccccaattctggcaaacgaattgtggtgattgatttcggtttgaaacatagcattttacgcgaacttgctcagcgtcaatgcaacgtcacggtcttgccagccactgccaccgctaaacaagttttaaattaccaacctgatggggttttgctaagtaatggtcctggtgatccgaaaaatgtgccgaatgccttggaaatgattcgcacagttgaaacacaggtgcctttgtttggaatttgcttaggtcaccagttgtttgccttagctaatggggccgatacgttcaagatgaagtttgggcatcgcgggtttaaccatcctgttcgagaaatcgcaactaatcggattgactttacggcgcaaaatcatggctacgcggtcgccgccgattcagttgagcaaaccgatttgttggtgactcatcaagaaattaacgatgaaactattgaaggtttacgccataaaaaatatcccgccttttcggttcagtttcatccagatgccgcccccggtccccacgatgcaagttatcttttcgatgagtttttagataatatcgacagttttcaacgtcaaaggaggatcagcacacatgcctaaacgtcaagatattcacaaaattttagtaatcggttctggtccaatcatcattagccaagccgctgagtttgattattctggctcacaagcttgtttagctttaaaggcggaaggttacgaagtcgtcctcgtcaattctaacccggccacaattatgacggatccagagattgccgaccaagtttatatcgaaccactgactttggaatttgtgagtcgggttattcgcaaagaacggccggacgccattttaccaacggtgggtggtcaaacgggattgaacatggctaaacaactggctgaagctggtgtgttagctgattttaacattgaacttttgggaaccagtttgaagtcgatcaatcaagctgaagaccgggaacagttcaaagagctgatgcaaaaattaaacgagccggtacccaaatcgttaacggtaacgaccgtcaaagaagctcaagacttttctgcaaaaattgggtttcccgttatcattcgaccagcgtatacattgggtggaacaggcggtgggattgctgaaaacatggatgagctcaccgccattgctaagaacgggttagacttgtcgccaattacgcaagtcttaattgaacagagtattgctggatttaaggaaattgagtttgaagtgatgcgggatcacaatgacaacacgatggtggtttgttcaatggaaaactttgatccagtgggcattcacaccggcgattcaattgtgtacgcaccagtgcaaactttgtcggatcgtgaatatcaaatgctacgggatgtttccttaaaactaatttcagcattgaaaatcgaaggcgggtgcaacgttcaattggccttggatcccaacagttatcaatattacattattgaagtcaatccacgggtgagccgttcgtcagcattggcttcaaaagcaaccggttatccgatagcaaagatggcggctgaaatttcggtaggtttaacgcttgatgaaattaaaaatccaattacccaaacaacttatgcagcatttgaacccgctttagattatgtggtctgtaagattccacgctggccatttgataagttcaatcatgcggatcgtctgttgggcacccagatgaaggctactggtgaagtcatggcaattggccgtaacattgaagaggctactcaaaaagcggtccgttcgttggaaattgggtccgatttgatgggctcatcagaattaacaaggctaacagaacaggaactcacagaacggttagtcagagctcgcgatgatcggttgttttgtgtcatggaagctttacggcggcagtggtcggttgccgaaattcatgaattaactaagatagatgaattttatttagataaattgagccatattttagaaattgaaactctgttgcaacaacatcccggtgatttagcggtgttaaaacttgccaaacagaatggctttaccgacgtcgtcattggcaaggcttggcataaaacagctgatgaaattagagccttacgtcgaactaaacaaatttggccagtgtacaaaatggttgatacgtgtgcggccgagtttgaatcgcacacgccttatttttacagtacctatgaagaagaaaacgaaagtcattcaagtgagcaacccaccgttatggtcattggcgcagggccaattcggattggacagggaattgagtttgattatgcgactgtgcattgtgttcaaactttaaaagctgctggttatcgggcgatcattatgaataataatcccgaaacagtttcaacggacttctcaatttcggacaaactttattttgagcctttgacactagaagatgttttaaacgttgctgatttggaaaagccacgcggagtgattgttcagtttggtgggcaaaccgccatcaatctagcgaaaccattagccgatcatggtgtcaaaatattgggcactgcggtcgaagacgtcaatcgtgctgaagatcgagatcagtttaatcaaattattgaagaacttaaaattccccaaccatatggcgataccgccactaccaatgaagaggccctcacaattggtgaaaaaattggctatccgttgttagtacgaccaagttaggtgttaggtggccgggccatggaaattgtgcataataacgaagaattaaagcattatatgcatgcagcaattgaagtttcgcacgagcaccccgttttattagatcggtatttagtaggtaaggagtgtgaagttgatgcaatttgtgatggtgacacagttgtgattccgggcattatggaacacatcgaacgcgctggcattcactctggtgattcaatggccgtctatccaccgcagacattatccacaaccgttattaaacaaattgaacaggccaccattcaattagctcattccttgaactgttttgggttgatgaacgtccagtttgtcattcatcatgaacaagcttatgttatcgaagtgaatccacgcgccagccggactgtgccattcctgagtaagacgactaaaattccaatgactcaattagcaacgcaagtcattatgggtcaaaaattggccgacttagggtatgagactggaattcaggcgccgtccaaactggttcatgtcaaagcaccgattttctcctttagtaaattaaaccgcgtggacagtttattaggaccggaaatgaaatcaactggagaagtgatgggcagtgactgttcctttgaaaaggcactgtacaaagcgtttgaagccagtggggttcacttaccagcccacggcaatatcttgatgaccgtgcgggatgctgaaaagccccaagcaactgaattagctcgacaattagttcagctcggttttaatttgtacgcgacagaaggaactgctcagtatcttacggaacgcggcgtgttagttaaacagcgagtcgagaagttaagtgaaaattcaccgcaaattgcacaattgttaacagatcaaaaaattcaactggtcgtgaatacggtggatgacaatatggagtccgttaatgatgataccaagattcgagcgctagcaatcagtcatgagattcttgtattgacctcactagataccttatcagcagttgtcaccatgctaaagagccaagcttacttaattcaagccatttaaaaaacggaggttgcatcgaatgtcagaaaataaattagcagttagtttacctggtttagaacttaaaaatcctgtgatgccagccagtggaacttgttggtatggtcaagaatttgcgcaacgtttcgacttgaatcttcttggtgggctggttgtgaagtccacaaccatagaaccgcgtaccggcaatcctaagccacgtacgacggaaacgactgccgggtggttaaacgccaatggtttacaaaatgtaggcgttaaacaagctgttgccgaaaaactaccttggctagatgctcattttcccgaattgcccattatcgccagtgcagcgggatttagtgaagacgagtatattgcggttgtcaaaggtttaaacgaatcacccagcattaaggcaattgagttgaacatttcgtgtcccaacgttaaaaatggcggattagccatgggaacggatcctaaactggtggaaaagttgactcggaaatgtgtagcggttagccgggtgcccctatatgtcaaactgacacccaatattacagatgtgacggcgatcgcaaaagctgctgaagctggtggggcggccggtttgaccatgattaacaccttgactgggcttagtattgatttgaagacacagaaaccagctttagccaatggtacaggagggttatcaggccctgctttgaaaccaatcgcgttagccatgatttataaagttcatgaaacctgtcagttaccaatcattggggtgggcggtgtttcgagtgccgaagacgttttggagatgatgatggccggagcgagtgcggtcgaagttggcgctgcgaatttccatgatccgctaagttgtccgaaaatcatcgcccagttaccaaccgtgatggacttttatggcattgataatttgaaacagttgcaggaggttcattttgattaagtattcgccgattgtggctttagatgttgctaatctagatcaagtaaacacaattttaaaacagttggacgttaatccgcggccgatggtcaaaatcggaatggaagtattttatcacttcggaccaaggatcgttaaacatgtgcaagccatgggatttaccgttttcttggatttaaagttgcatgatattcctaatacagtggaacgagcagcacgtgtgattggcgccctgggggttgaaatgactactattcatgccgctggtgggtcagaaatgttggcggccagtaaaagaggtttaatgcaaggagctcaagaaattggtaaagcaccggccaaactcctcgcaattactcagttaacctcgattgatgatcagattttacataaccaacagcacatagcgatttctttgcaagaatccgtgcgaaattatgccaaactagctgaaagtactggtttggatggcgtcatttgttccgcactggaagtaccggtgattcgtgaggtagttagtccggatttcttgtgcatcacccccggaattcgacccaattctgctcaaaatggagatcaaaaacgagtggtaacacctaatcaagctgccaaattaggcagtaacggcattgtgattggtcggccaattactcaaagtgcggatcctaaatttgcatacaaacagattgctgaagagtttaaggaggaaaaataagatgacaattgctgaacaagttgcacattctttattagaaattggcgcggtggcattacgcccaaacgatccattcacctgggcaagcggattaaaaagtccaatatactgcgataatcgattgacgatttcctatcctaaagttcgccagttgatttgtaaaggtttagtagaattaatcaaagccaattatccagatgtagaagtaattgccggtaccgctacggcagggattccgcatgcagcatgggtggccgaaaaactgaatcttcctctgatttatgtgcggtctaaacctaaggatcatggtcagggcaaacaaaccgaaggcgtactgaaacctggtcaaaaagtggttgtcattgatgatcttatttcaactggccaaagtgttttaggagctgttcaggcggtccagaaagcggatgcgactgcaattggagtagctggcatctttagctatcaattatcagcagctgaggtgaactttagggaagccgcgttaccattacacacagtcactaattacagtacattaatcagagtagccaaaactgaaaacaaagttagtgaaactgaacttgaaattcttaaaaagtggcggcaatagagaatacaaaaaatctcttctggtttataatcaggagagatttttttgagttataaaattagtttttagtaattttcttgggtaaagaggtaattaatatggttgcgagcacacacaacgcggcaaagaataggataacagagtggctaccaaccacggtttgtttaacttctgacaggttaggatatttctgagcggtcattgctaaaattgttgaagcaatcgcagtccctagtgatcccgaatattgttgtaaagtattaaaaattgcgttaccatcaccaatttgggcgggctttaattgttgcaggccaaaggttaacgaattgttgaataaaaagctgaatcctaacatgtaaactgtatagaaaataacgattgtggtagttgacaggtagtttgtaaagataagcaggagtccaatccccaacaaaatgaatattgccccaattgaaaatggtatttttggtgagtagcgattgagtaattgaccagttaggggagcgacaactgcagaaaataaactaccagccagtaacatcatacccgacagcatcacacctttcttcagggagagttgggcgaaggttggcagtacaaaagtcaaaccaatttgcacaaattggatcaaaaagtaaattagtacagctcgggtaaaaagcgagtttttgaaaatatgaatattaattaaaggctgactacttcgaagtgacagaatgacgaaaatggcaaaacacaaaaagccaaaaatgaaatttccatatacaagtggggttgttaaactaccactaccagcgtgattgatggccaaagtaagacctgtcaggcccaaaaagatcaaaataaattgagcaaacggaaaactacttttgactggtgactggccttgttgaatggtcgaaatagccagtacacagctgacgacaccgatcggcaaggttatccagaaaattagtggccagttatacatttgagtaataaaacctccatatgttggacctagggatggtgcaaaggcgacaaccataccggctgttccgacatattggccttgcttgctgagaggaatctgttgcataatgatggcaaacatgagcggcatggtcaagccagtactgattccttgaataattctaccaattaatagaaatgtcagtgaactggcagaaccagaaaatagaattcccaaaataaataaaataccggccgcactcaaaatcgttttaaacttaaaccgacgttgaacaaacgcagtgacggtcatcgttgctgctacgactaacaagtaggcggtcgtgacccattggacgttatttaagctttcatgaaactgagccattaaagtcggaaaggtgacgttcatggctgtttcgaccagaactccacagaaggccaagccagcggtccccacaatggataatttcgttttcgtactaattgatgatgtttcttgcataaaaaaacctccagaattctaactgaagcaccatataccttaataaggtatgttgcactttcactagaattggaggttaatttgttaaaaccgctaaatatcttctgttggaagtcgaacattgagcacaaaaatatatgtgcttcagttttgtttactttctcattatatcggataaattttgaaaataccaagtaatttttcagaaaagattttctattgagaatttgtgatttttgattctaatttgaagctgtgaatatgtggcaataaacagatttgcaagccaaatcatacaagttatgatgcgtttgaggctataataaaagtgattaaattataaaaaagggatgactctatgtcagattataaatttttagatccgtttacttttgcaaatggcgcaaccgtgcggaaccgcattgtcatgccaccaatgacagaacggagcgctttcgaggatggcgtggtttctaatgatgagattgaatactatcggaaacgagccggcggagttggtattgagattacgggctgtgcgaacgtttcggaacttggtaagggtttcgaaggtgaactagcagttaacaaagatcaagatgttgcccaattagcacgtttagcttcagcaataaagagccgcggtgctaaggcaatcctccagatttttgatgctggccggatgactaacagcgcaattttacgtggtgagcaaccggttagtgctagtgctgtcaaagcattacggccggattctgagacgccacgcgaactgagcgaagaagaagtcgaagaagtgatcaaagatttcggtagcgccacaaaacgcgcaattaatgcgggttttgatggtgttgagattcatggtgccaatacttatcttattcaacagtttttctctcctcattctaatcgtcgtcgcgatcaatggggtggtacgttggatcaacgaatgaacttcccagtaggtgttgttgaagaggttcggcgcgtcgttaacaaatatgcgccagccacatttattgtgggatatcgaatttcaccggaagaaattgagaatccagggatccgaattgcggatacattggcgttgattccttccttaattgaaagtggaattgattatcttcacgtttcgttgaatcaggtttggcaaacttctgcaaatgacaaaactgacagtcagccactgattgaaaagattcaaaaagtagtcgatcataaagtgccaatgattgtggttggtcagattacaaaaccagtcgaagccgaaaaggtgattgccgatgggtttgagtttgcggcaatgggccaagaacttatccgggaaccaaactgggttcaaaaagtgatcgcaggtgatgaggatgccattcgctatgagttgtcacccagtgatctagaagaattggggattaccacacctttatgggaattcttgaatcaaggctttagcaagacaattcatattacaagtgcataggctaaaaaactaattagcagaaacttctgttaattagttttttgagttaaagttgtgaaagtcgttttcgcaaagcagattgactcgcataaatatacaaacctcgaacaccacgttttaagagcacattaagggtgttcataataagttgttttttgattttagtgagctctttaggatccgttaaatcagcccgttttttaaagatctcactatccgtgactttggctaaattaatcgtgacgccatcagtttccggatcatattcgatcggcggtcccaaaataacgccaacataattcaggtcaaatccttgaaccgtatagattgacccaacttcattaatggtttctggtttttcggcccaggactgccgtgaataattatactgatcccatggcaacttaaagttaccttctacaatataatgtttgcccccgtctaatttggaaggatagccagtcgttgaaacgattctggataaaccgactttttgattttgtttgattattaactggtgcattgcttcggcatcgtcaaaaatccgaaaatcgaagtgatcgtccctgtgctgtggaactggggtgaggtggccatgtgtgaattcatcgatccaagtgactagcttgggatcgacctgcattcgaaactgatcgtgcaggacgtattcctcatgcgaatagggctgaacgatttgggataaacgtgcgcgatcccagtagcttttggtttttaaaacttggttttcatcgaatactaaaactacaattttgctgtgcttgatgatttcgactaattgattttgttgatcaaaattgttgtaacgatccggtcgcgacaataaaagatgggcttcatcaatgatggcaatgtcgtaagttagatgatccttgttgcgacgattgataaaagaggtggggcgatcaaagtcccttttaaacaggtgtggttgctcgccagcaatttcttgataaactttcaaaatctcgggatggttcaccagaaaaacgttttttgtaccgtttaaaggatcgtctaccttgctacgtgctgcggtttgaagatcgttaaagatctgacttaaaacaacgcttttaccagttcccgcttcgccataaatggtaaaaacggcatgtttagattgaccaaggtgcgcattaataaaagtcatgattttattttttaaattaagttgttctggtgataatttcttaaatggcgacagtttgtaacgcgcgtcattgagctgctttggcgtcaattgaagaccttctttcttaaaatgtcctaatttcatagtaagccaaaaagcgagatccttcaaagtggtatacttttcacattcacttgataaggaaaggatttatatagaatgttaaaaatagtcgcattaaacaaagaaaacatggcagattgggatgcttcaaacacgcaatttgagctaacaggacgggttgttccaagcttgaaagatgggcggtggacaattaaagaaatcccctttgaaacggccaaagcaactaaatttcccgctgaaaaaccagatgcttcgtatttagccgatccacaaaagcagttgtactttgcctatttggacggcaaaaatgtgggtcaaattcgaatgtttaggaactggaacaagttttgctacattgaaaatattgccattcaggcaggccatcgtcatgcaggaattgggcaacaattatttgatgctgctgaaaaatgggcgcgggataacaagtatgtgggtcttcagttggaagcgcaagatgataatctaaatgcgtgccagttttatcaaaaacaaggaatgaaacttggtggtgtggataccctgttttatacagccaatcctaatatcagtgttgcactacagtggtacaaaatattttaattttattttagttgatcaatgcaaatgttcgtaaattaatttttctttctttatacttaagccattaactgatagggggaaaataatgactttaaataagaaacgcgtattaataattggtgggacttcaggatttggtggtaaagtcgctaaactggcttctaagaaaggtgctcaagtgagtgttgttggccacaatcaagaacgattagatgaatttttgattgaaaatacagaaaaatatccaaatatttctggcaaagcttttgatgcgcaagatgcaaaatcgttaaattctttttttgaagaaaatgaaccggttgatcatgtgatttccacactcgggggtgcaatgggcggtggctttttggatagttctttagacttaattcgtaaaacgattgaggataagttttttgtgaatttgcaggtagctcaaattgccagtaagcatcttaacaaaaagggttccttaatttttacatcgggttcaggtggtcacccaagtgatgcgtctggtgcgattattggaaatcaagcgatcaatacgatggtcgcgggcttggcagttgaattagcaccaaattaccgagtcaatgcagtttcaccaacttggacgccaacaggattgtggcgagaactatcagcaagttctcttgaaacgcaagaatcgcagtttgccgaaaatgtgccgctaaaacgagtagggactattgcggaagtagcatcggcttatttgtactgtatggaaaatgactttatgacaggacaagttatgcgaattgatggtggcgtggatttgtaagggttcaaacaaaattattgtttgaggaatcttggtttcagatctttgattgctttttcattgagttttaggaccgttcgacaagtcaaaaggcagataataagcacgattcctgcgggattgcgatcccgcctccatcatgcttattatctgccttttaccgacttgtctcacgcacttactcgttatggtcctcacccggcgccgtatccaccaagctatccaacgtttccatatcttcatccggaatcacaaaatctaaattagtattttcctcaatatgggttgggttaatcgcctttggcaacggcacaatattatgctgcaaacagtacttaatggccaactgtgccaccgacacatgattattcttggcaatatctgctacatcttgattatgcaataagtaacccgttgccaatggagaaaatgcctccaccaacatgccgctttgtttggcaaaccgcacattaccagtttccgtatacccaatataatactgaagctgattaaccattggttcaatttcacagttttccaaaatgtttttttgatcctgaacattgaagttagaaattccaatcgcctttgcacgacctgatttataaatctcttccattgcccgccaaacttcgacgttttctttagaataatccgcacccatttcatcccatggccacggcgcatgaattaagaacaaatcaacataatccaaaccaaggttcttaatggattcttcgaaatattgcagactttcttcgtagctcttactttttgctggcaatttagttgtgacaaaaattcggtcacgcgcaatttcggaatcccgaattgctttacctacgctgtcttcattgccatattgccaagcagtatcaatatgacgataaccagctgccaaggcgtttttgacagcattgtatgtaacttcaccatcaggaatctgccaagtaccaaagccaaccttaggaatcttgacgccattgcgaagctcgaatgtatcagttagtacgctcatcaaacatctctccatttcgatttcaaatttataactcatgataacacgctttgactattcgaaaattaaattgcgaactaaaaacgtttcaccagaaatttctagtgaaacgcttttattaaactcgcacttttttacgcataaagtacttgcggatctcttcaattaacacaagtggaattggaatgcagactaacaaaatccagtcttgccagccaattgcagctgtattgaacaatccctgtaagaagggcacataaattagtaaggctaggagaagcacttcaaaaataatgccgccccaaatacgtcgattactgaaaataccaatgctaaaaattgaggaattctttgttcgacaattcaaggcagccgcaatttgacagaagacaattgcagctaacgtcatggttgtcgcttcctgataaacagaaccagatgctgccaacgccacatttggccaaccgtgttgatggttaacgaagaagtaacccacagttgaaatgatggacgccactaatccataccaggcaaaagccttcaaaataatccctcggtttaaaagatgagcagttcgtaaacgcggtggctgtttcataattccgggttcacttttttcagcccctaagcctaaagcaggtaacatatcagttccaagatccacagttagaatttgcataactgttaatggcaaaggaattaaaccgcgtgaaaacaggaataagattgaaggagcagcttcaggcatattactatttaaaatatataggagaaacttttgtaaattgctgtaaacggttcgaccttcttcaattgcggcgacgattgaagcaaagttgtcatcagtcaaaatcatgttggcggcatctttagccacatcagttcctgtgacacccatggcaaccccaatatcggcttttttcaaagcaggagcatcattaacaccatcaccggttgaagccacaatctcaccgatactttgcaacgttgaaacaattcgatacttttgttcaggagccacacgagcaaaaatcacttcaccctttaaagcttctttaagatcagcaatgtgcatttcagcaagttcgtcacctgtaataacacgcgctttgtcactagcgacaccaattttaactgcaatactcttggcagttaatgaactatcaccggttaccatgataatacgaatacttgcttcatgacatttgcgaaccgcttcaaaaatttctggacggggtgggtcttccataattgttaagccaacgaaggtgagatgttgttcagcgttttcgatcgtccagtctttagtatcatcaggtaaactatcatcagctgaagcatcccgataggcaattgctaaagagcgtaaaccttgggccgcatattttttgtcagcttcgttaatttgttctttatcagcttcagtaaggggacgcagtttaccattatctagaatcgtgtcactaattggcaggataccatccaaagaaccttttacacaaatagtagttttgccatcgacatcatgaaaagtggacatgcgtttccgatcggagtcaaaaggtaaagccccaattcgtggaaactttttggattctgattcaagattaattccagccttttcagctaaaataactaatgctgcttctgtaggggtaccaataattttaggattgtcaccagctacttttggctgttctaccttagtatcgttattcaaagccgcaacccgaagtaacatttctaagtccggttggtctgacagatcaacatctttggaatcaagctgaatatgaccgttgttcacatagccctgaccagtaacggtatattcatggctggctaaccaaaggtgattaatggtcatttggttttgagtcaaagttccagttttatcagaacaaatgacagtcgtttcaccaagggtttcaacactgtttaaatccttaactaacgcatgtttcttggccattcgagtaacaccctgggccaaagacagcgtaacggttggtaatagtccttctggaataaaagccacaatcatccctaaagcaaaaataaatgacttggccattgggtaatgcacaaaaaagattgcggagacaaaaaagatggcgccaattaaaatggcaattaccgataattgacgagttaaatgattcaattcgattttaaggggactggcttggtgtttttgattctgggttagtttggcaattttaccaaattcagagtgcatggcagttgcgaccgctactgcagtcgccgtaccactacctgcgacagttcccgcaaacacgagatttgcctctgaaaaacgacctacaccatgtgaatattcggcttgtttactaacaaggaccgattcgccagttagcgcggattcgtcaacttgaagggaggttgatttgatgatccgggcatctgcagagatactgttaccagcttgaataatgaatacatcgccaggtaccaaatcttccgaattgatttgcttcggtttgccatctcgtaacacttgtgcataggttggcaacattttcaacagagaattagttgctttttgagcctgatgctcttgccagtagctgaaaataccattgatcaaattgacggcccaaattgcaattcctagttcgaccatttgcgcaaaaatcgcaatgaaaccactgatccaaagtaaaattgccatcaagcttgtaaagtttttcaaaaaagctttaacttgcgattgctttttgtttctttgaatggtatttggtccaaatttctttagtaatccagctgcttgttctgaagataaaccggtttcctttgtatcaaagtacttatagacatcattgatatccatagacgcataacgtgttgtacttttttggtttactttatccaaaatactggcctctttctatccaattttaaatgcaattccttgcaccgtattagtataacgccatttgatgaaaagcagttatttttttgagatattaagcctggattttgttggattactacatataagtcatgtttttacagtctctgaggtctatattagagtttgagattgtgctatgaaaatatgaagctggaatgtagtggccataacttctgaaccgttttaatatgaaatactatatcccaattataatttttgaatagctgtctttcgagaagtttgcttaagaaattgacaaaactaaacctttcgatatcttttcaaccccacaatatttaaaactgtcaggacaatcaagaaaccaaacaagactgttatttctaatccaagtgacgacaaacccgcgccacgcatcataattgcggttactgcgtctccagaatacttaattgggacgatatatgaaattgtcttaatccaactagccatctgatccaacggaatgataccagaaaagaagatctggggaatgaccactaacgggataaattgcatcatctggaattcagagcttgcaaatgttgataacagaatcccgaaggctaacgctaccagagccaataacaaattaatcaaaataatgctgaacaaactaccaaccacttcagcgccaagtaaccaaaccgtgaccaatacgatcagcacggtttgaaaaatagctaagattccgtagctggccatgtaaccaaacacaatttcatagcgtttaacgggggtcgccagcagacgatctagcgtaccactattccgttctttgagaagtgccattccagaaattaagaaaacaaagaagaaaacgaaaaatcccatcagaattggcaacatcttatcaaaaaagctggtgttagcatcgccgtatacataatggtttgtgatttttggcgtggccattttcttagaactaacctgtgctagtgtcacgtgattagatttagaagttttaactttttgattcgtcgacttggcaacttggaactgtaactttgccagtgctttggaagtgattgttaactggtgtctgagtttgccgatgacagttgttgaagttttaagacctgtttttagctcggcagttcctcgggctgtcagggcatttttaaccgccattttaaccgctgtggttttagtggaatcagtattcgcatgggtcagtatataatcgttatgctttttttgaataatggcatcgatgtgagtctttttcaatgctttttcagcggcagttttggaatcatataatttcacgtcaacatggttgcctttacccaattttttattcatggcttgggacaacgaaacggttccgattgtgacattcgtcgtggaattcgatgaaaagatggcattcattaaaaacaaaatcaaaattggcgccaaaaacatcaaagccagtgtccgcttgtcgcgtaaaagttcttttaaaacccgaatcataattgcaataattctcatagttgtacaccttctgccttcaaaaatacgtcttcgatcgagttcacttgatactgctttttaagagcggcaggtgagtcaaacgccataactttaccgtttaaaattaaggctacttcatcaacaagttccgcttcatccatgacttgggtcgtgatcaaaatactacgattttcgtgacgaattgtgtttaattctttccaaatttgacgtctcagagcgggatcaatgccgccagtgggttcgtccaaaattagtagctctgggctgcctaataaggcgattgccaaagataaacgccgcatcatgccgccagaataactgctaacgcgtttatttaagtcggtggttaaatcaacaacctctgcgacatgggcaatttcagcatgaattgtctgtttttttagacctttcatttgtgcaaagaacatcaagttttcttgaccactcaacgacccataaagagcgtccgtttgggccatgtagccaatgcgagacaaaagctttcggttgggcattacctgattaaaaacggtggcggaaccaccatcggcaacctccattcccagagtagttttgatgatggtggatttaccggctcctgagggtccgatcaaacccacaatttgtcctggtgaaaccgtaaaattaatatcttttaaaacggtttgtttgccaaattgtttgactaaatgattaagtgaaatacttgtagatgacattgaagagtcctcctttaggcgggtgagtaattactcacctttcttcaaaaatgattatagccggttctatttttaaagtcaatatagaaaaaaccctcacagctattcaatagttatgaggatttcagtttaatgttgcacattaatatccggtttttgttttgtactggaaatattcaagacgtactgttggattaagctgacgatctccccattttggggcagatcatgatgggtcgtgtcttcaccagttacggtgatttgagtgtaattctttgcccgtttttggaaaatatatttaccggcttccacactcgcaaacggcaccgttccgtcattgttgtagttttccgtgccggccacggaatacatgactaaattggttggaatcttactattatccttaattaaatctgtcaatatttgggtacgtttatcaatgtttgtttccgagaaattatagggtgaagcaatggtcatcaatgtgttaatacgcattttttgttggttaaaatatttttctaaataacgggttaaaactagaccaccattggaatgaccaattgcagaaaagtgattaaatcggtatttggcactcaaaatggtcatggcgtggctaaaccatttagcctgttttttaatatttgagtagccatcatggttattttgaaacgcaatgacaatgtatggatggcttttgcctggttgaaaagtgccactatatgaaaggtggttatccgtatgaacagttacttttaataaactactggatgttttggttttaccattcagttcattgaccatggcatcaaagcgctcttgagtttcactgctaccgggcaccaaaataattggtgagacgcgtgaatttgctgatggaatggtattgcgcatgttttggtgggtccattgcaaaccgaaaacggccatgaaacccagtaatacaaataagattagtggacgaatccatttaagcatgagactcatctccgtttctttctggcaattgatcaatcaaagagacgaatgggtaataaattaagcttgataggatcaaaccgattaaactgacaaaaagggcgccaaagtttccgtttgttcctagaaaggctcgtaaaatacttggtgttgcatatggaattacgtaggccgcagccgggacgagatgtgtgataatggctaaatagccaatgctcatactgacaaacggagcgactaaaaacggaattaagaaaagcggattaaacaaaatgggaatgccaaacatgagtgcttcgctttgatcaaaaacagtttgggttatggataaactggccaccaaacgggcgcgttgatttttaactcgaaggaggatagcacctgccagtgccagtaacatgccgtttccgcccaacgccccatatgagtcgtacaacgaatgtaacgtgattggataaggaatgattggataaggaatgttccagagattatgatgttgggcaagatacgttaaattggcggtctctgatgaaaaatgattgccgattgtggtggtgaaatcattaatgatgccaaaaaagtggccgaaattgctaagcagagttgcaaaagtaattttccaaaaggttggatgatttccagtttgtaagaagttttgtacttgttgcgatatgtaattaggaaagagttgtgtttggtagaccgtaaagctgatgccaccaattaaaatgattaagagactgaaaatcacaatgagatgagtagtcgcccagtaagtcacggttaatttaagtgaagatcttttggcaagaaaactgtatccatatccagtaaacaggccaatcaaaatcgggatgagtaaattacccgcaacgtcagtgatttgtggcaaatcaagattgggtgcagtttcaacgatgagcaagaagtaaataaataaactcgtaatgccggctaaatgttcatgagatagctttgcgcgtaattcgaaaagattttcggccgtaaaaaaggccagtagtaatgaaatggtgataaaagtcaggtcatttgtggatttgagcagatatgagatgctgttaaatccaggcaaattggtgtgcagatcccagatgacttctaaaataccattacgatggaagcaggtttcaaaaataatgtgaaaactaacacccacaaattctagcgggaaaattagccataaggccgaaaggattgcccgataaaaattcattttatacaattttcgtgtcacaattaataattgcttcattgcgaatcactcccccgtgagctttccttgattatacaacatctagattggttttgatgagtggtagaagggattaagtgatatttagacgacaaaaaaaccagcaactaatttaattgctggtctttttcaattaatcactcaaataactctctaaagtgacttgaacgtgtttacgtttacggacaatttctggtgtgacatgtggcaagaatagcacagtctctttctttgcttccgtaaccttttggtcttggtgaatcatctgccaaagggataataataagagggcacagaccgcgatcaatgggaatcccgcgatagaactaattgcttggaccgttttaaagcctccgacaaatacaatcccaaacgagaagataatgaagacaattacccaaattaatcggttaaattgactaggttgctcgccaggtgccaaatgtttacttgtaaatgacgacacgatgaatgccgatgacgaaatggttgtggccaaaaagataaaacacgaaatgctgtagattactaacatgatcatctttaatggtaaagtgctgattacggccgcgatggcagctgcttgtccttgggtgttcaaaatatgaacaaggttgattaccccagtttgttgtagataaagtgagtaaccacctaaaatagcgtagaagctcatgcagccaagggcaccgtaagtcagcatgccgacaattacctgacgaatggttcgaccacgagaaatacgggcgataaataagcccataaccggcatataggataaccaccaaccccaatagaaaattgtttcttgttgagcaactccaggtttaccgttggttgtggtgctagcactcatcgttataaacttttcaaccattaaacgtaaactgttaccttcatcacggaagatggttagcgttgggccgataaataaaacaatgagtaagaaaccaatggcagtccaaatatgggcagcactaagtttatcaatcccacctttaatcccgtgaaacacggtaacagcaaagatgacaaacaaaattaagaacataaaaagttttaagagtaaattatcgggaattccagtaatttgattaatgatttttgaaagaaccggaatttccatgccgacggatgaaccaatgccacccatgatcccaaacacaaccaaaaagtcgatgatttgacgaataacttttttgtagtgttcaggtccttttagaaatgaaatagcggcactaatccgcatgacccgtacgttacgaacgtacataacgtaagcaatggcaatggtggcagaagcaaacatcatccacgccatgggaccccagttgaactgacccaacatgtgagcatcaccgtaagaggcggcagaataaggcttgtcaccaaaaacggggctttgaacgtagcgtaaagggtcaaccatactgagcatgagaatgctggcgtcgatggcggtggcaaaaaccatgctaccccattggaagctactgtactcgggtttgtcattggcgtgaccaagtttgattttaccaaaatgactgaaggcaaggtacatgaagaatacgaagttaatgatgtagatgccaagataagcccaggacatgtgagcggtgatcccgttcatgacgtcgctgagaacggcacgaagttgggaaccgccaagaatgagtccaagggaaacaagggcgaagagactaacggttggaataaaaacggttttatcgatattactgtggtgtaaaataatgatcctcctaatatataagtgagtgtagggaggcgattagtcttgaatgtgtaagcgcgccgtcagcgggaaggattcccgcgctaggcgtgtttacatattcaaggctgcctccagaaactgtcctaagaaaaagtgagtgccaagaggcgtcaagttcaagagatataagcgcgccaacagtgggataagggcccgcactaggtgtgtttatattttttgaactgcctcttgaaactgtcctaaaacagcaagaaaagtaataaaaaaattgaattaactaaaatcattgaaaaacaagtgaaaataaaaacgaggttaaaacggtgttctgaaaactcctgaaactgaacaagcaagttttcaaaaataaaaacaaaaaaacaccgtcaaattatccattaaggatatttgcacagtgttttgggcttatacaaatattaatgaattcgctcgcttttcattgattgaattaaatgtgccaaaaaaggtggcttctttttaacctattagggcagaaactaagcccccttttggtcacctttgttcttaatcacatccccattactatctaaatgatgaatgatgcgagctggattgccaacaatgaccacatcatcaggaaatgacttggtcacaactgaaccagcaccaacgacaacccgattaccgatagtgacaccgggtaagacagtcacgcggccacccatccaaacactgtctccaatggtgatgggtgcgcccatttcaacatccgcattacgccttttagcgtctaacgggtgaactggagtgtataaaccaacgttaggaccaaagtagcagtgttccccaattgtgatgggacacgtgtctaacatcgtgatgtcgtagttcccataaaagtgatcgccaatatgaatgttaaatccataatcgaatttaaactcactttcaacaaaaaagtggtcaccggtctgggcaagcaaactttggaaacgctggttacgattatcgttatcagtaatctggttaatctcttgaagttgttggcgaattagcttgcgtcttgcaatcaattccgcatcaaactcctggtaagattcgccagcggtcattttttctctttcagttttcatagtactagcctaccacgtttgcgtcgatttgttaaaagggggtaaaagaaacgatgatttgaaatgccgattgcaaggtgtttttacccatttgttgggcgactggatcccaagtactgctttgctttcggtacgctttggtaacttgttgccagtgctttaacagatcatttactgaaactgcctgtgtgtcatctaaaatttcccaaaatgtgttgataaattgctgggcattagcgcgggtctgcttgtgaatccaggggcataattggtgatttaaaaaatcatcagttgtctgtgattgacccaaaatgactggatcagcatcgtgtaagtgccaactgtaaaggtcatgctgccagattcctgttgccatacttgtgactattttgggcgcgtttgtaaacgcagatccaattccgaaaaacggtaattgaggcagataagtttgaaaacgggtcttgaaagtttcgggaagatcatctgttgaagtaacttttgggccatcaaaattgattacttgtttaattcgatttttcgcatcaatttgactagctacgtaaatagccatactaccacctttggagtatccaatgatttgaaaattatcagaatttgcatgcatagttttttctaaatagttccgtgcaaaactttgccatcgttcaccatttggttcgtagagaacttgaagatctgactgccagcctaaagtagtgccatcggcgccacggaaaacaataattttggtatggggagccacacgcacggtaatggcagcacactgattgtctaagttttctggtgattggattttaaaattcgacaggctgactttttcataacgaaaagaagtttgtaacttttgaatgagaatccggtcattgggaagcaacaaatgttctgaagtattggccaactgagtttctaattgctttagtgcttggggcaaggcaatttcatcgtccaaattacctgccacaatatcttgaagtggcaaaaatggtaaccgggtcagaatcatctgatcagccacatttaaatcagcagtgatgggacgattatagttatctaaatagttcaacagatcaggcattttcaatttctccccaaacaacgatttccgattggtatcttgattagaaaataccattgaaacgccagcgagtcaatttgcaaatttaaaaagaactagtatgataaaaaagaactagtatgataaaagtgatttgttagaaccattctaaacgagagggagttttaatatggtgataaatcaaaaacgacgtaagttttcgccatcactagctcaaaaaattagtgtcatgcgggctagtgtgatgggcgccaacgatggtatcttgtcggttgccggaatcgtcattggtgtggctggagcgacgaccaatagtttttcaatttttatttccggaattgccgggatgattgccggaactgtttcgatggcgatgggcgaatatgtttctgtgaatacgcaaaaagacgctcagcagcataccgttcaattagaaaaattggccttaaaaaacgactacgacaaagagtttgcaacagtgaaacaaaaatttttgaattctggaatttctgataaactcgctcaaaaggccacgagtgaaatgatggatcaaggaagtttgactaccgttgttcgtgaaaaatatggcattaatgtgcatgattacaccaatccttactttgctgcgatagcatctatgatttcttttccaaccggatctttattacctctcttagcgataacgtttatatcgcccacttataaaattccattaactatttgtgcagttgccattgcgctggccataactggatatctggctgctgtgcttggtaaagcaattcggtataaaggggtcgttcgaaacgtgatttcgggactcattacaatgctagtgacctatctcattggtagtttatttgcatgatgggagagacaaataatgcaaaaaaaattaagtaatcacaaaaatatggataattggttaaacactttgcgagccggtgtgttaggtgcaaacgatggtattttaaccgttgtgggggttttgtttagtgtagcagccgcaacgaccaactctttcacaatctttattgcgggattgtcggatctgttagcctgtgcgttttccatgtcagctggtgaatacgcctcagttagttctcagcgtgatactgaaaaatcagttgtgggtcaagaaagattattattaactactcaatttgaggatgaaaaagaacgagttgtgcgcttttacgaagaaaaaggtgttcatcaagaaacggctcaggccatagcagatgaattactgaaccaaaaaggtcgggcacttgcgacaattgtcaatattaaatacggcatgaacttagataattacctgaatccttggcaagcggccgtgtcttcattgttttctgcgtcatcaggtggtatttttccacttgtggcgatgacctttgcaccagccgggtatcagttattagccacgattattgctgttcttttcgctgtgactttgaccggctatttaagcgcacggcttggcaatggcattccaaaaaaagcggtcattcgaaacattgtggtaggaatcattacaatgtttattcactattacgtgggaaaacttttttaaacaattaaataaattagtgaaaatcctattaggtaagtgtttgcagtttgattacaaacacttttttgttatattacgggtattttattttaggaataccaaaaaatggagtttactttacttggttttaaattataatggagttgaaaaaaggaggagatcgttgatatgttagaagatatggggaatggaaaaaagcatgggttattgtactacgcaaacggaccaagtcttgaagagatcaatagcacggtgccagtaccaaaagaaggtggctttttcaaaaagttgatggctttctcgggaccaggtgcattagttgcggttggttatatggatccaggtaattgggtaacttccattggtggtggtgcccagttcggttacctacttgatgtctgtgatcttgctttcgagtttaatcgccatgttattacaatatatggcgtctaaactgggaattgtgacacagatggatctggcacaagcgacgcgagcacatacgggcaaagttttaggaattattttatggcttacaacagaggctgcaatttgtgcgacagatattgcggaggtaattggtggagccattgcgttggagcttctttttagaattccactagttttaggggtcactttaactgtattcgatgttttgctcttattgttattaacaaagttaggttttcgaaaaattgaagcgatcgttgtgacgcttattgttgttattttggctgtatttgcctatgaagttggcgtttctaatccaaactgggcgtccatgtttgccggatttgtgccaaaacctcaaattttacatccaggagagttaaccatggcactaggaattgtgggtgccacggtgatgcctcataatttatacttacattcatcaatttcgcaaacacgcaagattgatcataatgatgaagatgcagtggctgaagcagtgaaattttctacttgggattcaaatattcaattaactggtgcgttcgtgattaattgtttgttattagtgcttggggcagctttattctttgggcatggtgaagggttaggaaccttcacttcactatttgatgcccttcaagataatcagttggcaggcgcggttgctagtccaatcttaagtatactgtttgcggtggcattgttagcttctggtcaaaactcaacgattaccgggacgttaactggtcaaatcgttatggaagggtttatccatatgaagatgccattgtgggcacgtcggttaattacgcgattgatttcggttattcctgttttgatttgcaccattgcatatgggggtaaggaaagtgcgttggatagtctcttagtcaattcacaagttttcttgtcagttgcattgccaatttcaatgattccattgactctgtttacttcgtcaaagaaaattatgggtaatcggtttgtgaataaaatgtgggttacagttttagcatggctgtgcacaattgttctcactattttaaacttacaaattgtttggcagtcattaacggcactatagaggaggaatcttatgaatccgaaagagtttaaaaagatcttggttggtgtagacgattcacaggatgctcaattggcgtttcgatatgcgatgaatcgtgcaaaaaatgatggcgctagtttagtcattgtcactgtttcagaaaatgatgatatgaatgtgtatcaagcactcagcaaagattatgtaaatgaaaaacataaacgacttatgcagcatatcgctaaatatcagcaggtggcagaacaatttggcgtgaaagacgtttcaacagtcgtggcacaaggtaatccagggaaagtgattgttgatgaagtcatcaaggatgtgcagcctgatttattggtaattggcgctcaagctaaatctgggattgaaaagcattttggtagtcaagcagcatacatggcaaaatatgcgccaatatccgtgttggttgttcgttaatatggtaggaaaattagaacgggaaaagtggttagattctgagcggaaggatctgcccttttttctcgttttaaaaatattattcgggaagcataaagagaccgtaaaaaaaatattttttattcggccttttttaataagttgttcataaaaagttcttgcttctttgttgaatagtctgtacaatgagttcaactacttacaaaaagtaagcgcagtaattctagtatttaacttaaaggagaacttaaagatggcaaaaatgaaagcaggacaagcgttagcaaaggttttagaaagttggcaagtagatcacatttatgggattactgccgattctattaataatactgtggatggtttatatcaagaaaaggacaaaatcaaatacattcaagtacgacatgaagaagttggttccttagcagcctctgccgatgccaaattaactggaaaaatcggcgtcagttttggttcagccgggcctggtgccactcacttattcaatggtttatatgatgctaaaatggatcatgcgcccgttttagcaatcgttggtcaatctgcaacaggagttatgaacacgtccttctttcaagaaatgaatcaggacccgatgtttgttgatgttgctgtgttccatgaacaagtggtaagtgcacaccaaatcccttacgtggtcgatcaagccattcgggctgcatatgcgcataaaggtcctgcggttgtgattattcctgatgatttatctggacaagaaattgagtttactgagttcaaaacagctcctatttataaggaacaaatgcacaccaagtttgatgaaaaaacgattgatcacgtggtgtctgctattcaaagtgcaaagcaccccgttgtttgggctggtgtgggattaaaaggagcaactaaagaactagttgctgtttcagaaaagttcagtttaccagttttatcaaccgttccggcaacaggtgttatgccaactgatcatccaaacttcatgggttcgcgaggtcggttggggactaaaccaggttttgaagtttctcaaatggcggatttagttatttcagttggtacgaattatccattccttcgttttttgccagaaggcgttaaagtgattcaagtgaataacaatgccgctgatattggtaaacaacgtgatgtggatttggcaattctcggtgatggtcaagactttttaaaggaattgttgaaacgggatgtcacaattgaaacaactaatttcttaaaggcggctcgtttagacaagcaaaattgggacaaatggttggacactttggcaagtgatgattctaaaggattgcctgcagaagctgtcatgaaaaccataaaggcacattcaacagatgatacaatttttggtgctgacgtgggtaataacacagaatgggctattcgtcagattccattgaataagaatcagaagtttaccctatcatcttggttcgccactatgggctatgggttaccttctggaattgctggaaaattaagttttcctgatcgacaagttgtgactatttctggagatggcggttttgcaatggttatgcaggatttgttgacagaagttaaataccaacttccagttgtgaacgttattcttgaaaacaaagtgtttgggtttattcaacacgaaaaaattgctgcaaagcaagcaccatatggaatcgatttactgggtgcaaactgggcaggtgttgctgaagacatgggcgcaattggtttcacagtaactgaccaaaagtcgttagacgcggcatttgataagattgatgaattacaaaaagccggtaacacaaagccaattgtggtggatgcaaaggttaagaatgtggatccaattgatacttcatttattccaatggatccagatcagtttgatcaagagacaattgataattataagaagacttacaacgtgtttggccaaccagcattgtcagaaattttgaaaaatttgtaaaaacaaataaaagtgagttctgtgagaggttaaatttttcacagaacttttttacttgttgtgatttttctaatgttaagagataaattttagaagaaccacgctaaatggtataattcttatcatagagacttatttcttagcaaagaggcaaaaaaatatgaagttaatttcgtggaatgtaaatggcattagagctgcagtgacacatgactttttgacatcttttaaaactttgaatgccgatattttttgtattcaagaaactaaaatgcaggaaggtcaacttgagctagatctaccgggttattatcaatactggaattatgctgatcgcaagggttattctggcaccgcaatttttacgaaaattaaaccactcagtgtgaagtatggcatgggagtggacgtgcatgatcatgaaggtcgtctgattaccttagaatatgaggggttctatatgataaccagttatacccctaattctcaaactaaattaaaacgattagattatcgaatgacgtgggatgatgattttcgccactatgtcaaccaactggctgaaacgaaaccagttattttctgcggtgatttaaatgttgcccacgaggcgattgatattaaaaatgataagagtaatcatcacagtgctggttttacagatgaggaacggggaaaattcactgaattgttagcaagcggatttaccgatacgtttcgctatttctatccggacaaagaaggtatttattcttggtggagctatcgatttcatgcccgtgatcacaatgccggttggcgaattgattattttgtggcttcaaatagtttgcaggataaattacaggatgctaaaattcataacgaaattttcggatcagatcactgtccggttgaattggatgtcgatttaaaatagtttttagtgtggaggaattaaaatggctttaccaaaaccaacttcaaaatattctgaacaagaagcgagtgatactgcccagcaattaaggaagacactggatcaatggggaaaagattactacacaaaagataacccggaagttgaagatagtgtttatgatgaaaaatatcgtgatttgcaggagctagaagccgcctttccttcaattgtgacaccagaatcaattacgcaacgtgttggtggagcggtcctcagtggctttacaaaggtgcgacacgaaattccaatgttatcaatgggcgatgtcttttccaaggatgaactcgttgaatttgataatcgaattcaaaaaaatgtgggctatccggtcgattataacgtcgaattaaaaattgatggcttagcgatttccctagtttacgaaaatggcaaactggtgcgtggatctacgcgtggtgatgggacgattggtgaagatattaccaagaatctgcagaccatcacttcgattccgcaaactttaacaaaaccggtttctattgaagttcgtggtgaatgttatatgccaaaacaagcctttgccgatttaaacaagcagcaagaagagcgtggggaggcggtatttgctaatcctcgaaacgcagcggctggtagtttgcgacaactcgataccagagtgaccaaagcacgtaaactagacacatttatttacaccatcagtacgtttgataatctgcaagtgactactcaacacgaagcgatcgaaacgcttgaagaacttggttttaatacaaatcccacacaacgggtttgccataatttagatgaagtttgggagtacattgatgactatcaagcccaacgtgaccagcttgcgtatggcattgacgggattgtcctcaaagtgaatgacttagatttacaaggccaattgggtcacacagtcaaggtgccccggtgggaaattgcttataaatttccacctgaggaagctctgacggtgattcgtgaaattgaatggaccgttgggcgtaccggtgttgtgacacccactgccataatggatcccgttcagctggccggatccacagtggcgcgggcgacgctgaataatgtggatcaaattgcggctaaaggtgtgcgtcttggagataccgttaagttacataaggcgggcgatataattcctgaaattactgaagtgattttggataaacgcgacgagaatagtgcaccattacagattccaacacaatgtccatcatgcgggcgtgatctggtccatttaaacggtgaggtggcattgcgctgtattaatcctgattgcccagctcaaatggtggcacgtttagagcatttcggttcgcgaaatgcaatgaacattaatggattaggtccgcgtttgattcaagtatttttcgatcataaattagtacgtagcttttccgatctttattcattgaatcctgatgatttagcacaattagataattttaaagaaaaacggattaacggattattggagtcgattaataatagtcggcaaaattctttggaacgtttggtaaacggaattggaatcccaggagtaggtacaaaaatggccagaatcctggcagagagctttgggacaatggatagcttagcaacagcgagtgaagaggaactaacggccattgatgcggttggagatattttagctgctaacattgtgacattttttcaaagtgatgcggcaaagaatactatagaagaattagcagcttcaggggtcaatatgacttataacggtccaactgcaacacaagtagtagataattactttaatggtaagacagttgttttgactggaaagcttgaaaattacacacgtaacgaattaaaagaaaagcttgaaaacttgggtgcggatgtcacgggctcggtttctaaaaaaactgatttgttaattgccgggactgatgctggaagtaagctgtcaaaggcacagacgctaggtgttgaagtcatgagtgaaggcgaaatagaagagagattttagcctataacgagtgccaacactatatagtgttgctttcataagttgtaagcttcgttgacggatgaaaattaatcgactatactatcaaaatgtgagttatcaaatgtctaatattaaggggttaacgaaatgcatacaatgtttcagataatctccgaacaatttcaaaattataaaattattcgaagaatggcaaagtttgatgatagagccacataccaaagtcattatttgggattggcctgggagatattgaaccctctaatccaaatcggtatttactatttagtttttggtgtagcgttgcggcgtggcgatccaatgccaggggttccttatctaccttggatggtagtagggatcacaccatggttgtatatgaacagaagcgtattggacgcttcaaagagtgtttatcagcaagttggactagcctcaaagatgaaatttccagtgagcattttaccttcgattaaaatcgtgggtaatttagcaagtttttggacgatgttagcattttcaatttttttgatgttggtcaatcatatttatccatctattgcttgggtacaatttatttattactttatttgtatgattgctttgttgtatgctttaggaatttttaattccacggttacggtcttaattcgtgactggcaaattacgttgcaatctattttacggatgcttttttatatgagtggtgtgttatttaattttgctacttctaatttcccaacacttttaattcgtattttggaattgaatccattttattatgtaattaatggtatgcgtgaatcgttgcttaataaaggatggatttggcaagaacctaatctaaccattacaatcgttttttggatgtttgtttttattatgatgacgtttgggacgttcttgcataataaattccgtgcaaactttgttgatttgatttagaaaatggagactatgtgattatgtctgaagagtataagatcaagcttagaaatgtgacaaaggaatatgatctttatagaacaaaaagtgaaaagttaaaggccttttttaatctgacgaagcatgatagtattccacatttttggtcactaaaaggggttagcttgactatctataaaggggagtccgtgggaattattggtgttaacggctctggtaaatctacgatgtccaacattatttccggtattatcccgcaaacaaccggatttgttgatgttcgcggagacacttcgattgtggcgattagtgctggcttgaagcgaagcttaacgggacttgaaaatattcgtttaaaagggttaatgcagggactgtcatttgaagaaattgcggcagttcgtgacgatattattgaattcgcggatattggtgattttattgatcaacccgttaaggattattcgtcgggtatgcgatcgcgcttgggatttgcgattgcggtgcatattaatcctgatattctaattattgatgaagcattgtccgttggtgatgataccttttatcagaaatgtttagataagattgaacaatttaaaaaagagggtaaaacaattctgtttgtcagccattcgttaaaacaagtggaaatgttgtgtgatcgaactgcttggattcactttggcgatttaagaatgcttggtgacactaaggaagttgtggcggcttatcggaaattttcatctgatttcaagaagaaatctgctaaaggccgttctgagtatcagaaagctaaaaagcagctacagttaaactttgatgtagatgcctatgaaaaacaaattgcaaatgagacgcgtgaaaaaatggggctcagtgatcatgaagctaggaaacaaacacataagctattttatggcgaagtgttacctagtaaaatgacgactaccagtaagtggcttgtattacttgcggtattcttgatgttcttttttgccatggtaaccgtttcagggcgttctgttacaaaaagtattacagatcccagtgcattgttacatcctgtttatcccaaaaatacggggacaaaacaattgtttaaataactaaaactattgactactccttgccgaaagaagctattgttgtctctctcaccctaaagactgaaattatgtcaaaattgtaagaaaaagtataagatgcaaaaacttcagtagaatatacagatgttttaagaaactccaatcaaatagtgaactatggtattatataaggtagtcacttttgctgatgtctaggggggagaaaaatggctgatatttacaaaaagttaaacataagaatttgaacaaataacctcaatgactgcttattgaggttatttgtgtaaaaaatatgtaaatttaactagttagtaaaacaacagctaaagtgtgtagaattaaaaataacaaacagtaacttacaaatgctgcggaggaaaaatgactaagagtaaatttcaagaaattataaattttgctttaggacctataaatgaatatttaacaaaacctagaatacgtaaaaattcctattatttgaagcatctaagaagaggaagcataaagaagaatgcggtgttactagagtcttaccatgccgtaagcttgacaggaaatgtttatgctatttttacaaaaatggttcaggaacatccgaacttccatttttattggattttttctgataagaacgaccaaatgattaagatgatacgtgaagaatggaaaggtgcaaaaataacttttgtaaaatatgaatccaaaaaatattacaagtgcctggcgcagtgtgagtatctaatcaatgatacttcatttatgccctattttataaagcaaaaggggcaagtctacataaatacttggcatgggaccccgttaaaaacattggggatggatattaagaatgccaaaagatcagctcataagaacattcaacgaaatttgttgcaagctgataaaataatcatgcctaataaatatactgcagatcgtctggttagttctcatgatttgaatggaattttgccagcaaagatctacgtcactgggaatccacgtgttgatttaggatttactactccaaatgacataaaaaagaagtatggcttaccaaatcaaaaaataattctttacgcgcctacatggaaaaaaagtttaaaagaaacaaccatcaaagatataaataagattttggatgaagttaataccctccaaaaaagtgtaggcgacaggtataaaattatattaaagtctcattattttgtctatgattttttcgtgaaaaatggttatgaagataaaattatttctaattccatcgagaccaatgaattgctggcagcagtagatatactgatcacagattattcaagtatcttttttgatttcttaccactcaaaagaccagtctatttttatattcctgataaggatgcttatgaaaattcacgtggcttttatttgaagctggaagacttaccaggcttagtgactactaagttagaaccaatcattaaaaaattaaacgagaatcaacgtgaatatttgacgcagtataatgacaaactcaataaatttttgactgaattttgtaaattcgatgatgggcatgcacgcgaaagagctttaaaggcaatttttaatcaaaaagatgaaaaaacaattgagttaaattataattctcccaaaaagaagcttttgttttatgctggaggatttttaaataacggcattacaaattcaataatcaatttgacaaataaaatcgatttggagaaatatgaagtaatctttatggagtttagcaaaatgaatcaaagtcggcttgcaaatttaggacgcttaaataaacatgttcactttgttttcagattttcctatatgaatagaacattgtttgatacttttaatcagaacatggtatttcgacaaggactcaattctaaaaatgtaaatcaaaaaaaatttgttaatctcaataattgggacttgaagcgtctaattggtaacctcagaccagacgtgttaattgattttggtggatataataaaaaatatactgctttgtttggattatcaacactagccaagagaaaagtgatttttttgcacaatgttatgttgaatgaatataataaaaaaatcggtggtgtttataaacacaaatggaacttgaaagccatttttagtttttacgatcaatttgataggattatttcggtctcagaaagtgcaaacgagaaaaacaagctggaccttatgccatgggtgaaggaaccaaacaaaaaaatgcactttgttgataatgttattgatggagaacatatacaaaatgtattagcgactgtcgacgataaagatattgtttcagctgctaaaacttatgatcataaagtaaggatcgtttatgaacgtacgttaaacactgcaggtgtgttggaagaaaaaagttttatattaccaagtaaaaataatattaattttgttaatgtagcacggttatcaccagaaaaaaatcaagtgactcttattagagcattcagaaagttaattactgaatttcctaacgttaagttgcatattctgggagagggtccttctagaaaacgtattgaggatgaaatagtgaagttgaatctgacagacagcgtgtttttgtatgggtttatttcagatcctataacattcgtccactactgtgattgttttgttttaccttctaaatatgaagggcaaggtctatctttgattgaagcaatgattgcaaaaaaaccagtaattgggactaatgtacctggaattaagtcggtattgaaaaatggaaacggattgttggttgaaaatgaagtgaatgagatttatcaaggaatgaaaaagtatgcactaggacaactaaaacctgcaaaatttgactttgataaatataatgatgaagctatgcatgagttttacgaacgtgttgtaaattaataactataatgtgttgcttcaattcattttctgaaaggtttgtggttcgaattatgtttaaaaatgtaaggaaaaataaaaggaatatttgggaattattcggcattatagtaagtttcggattaatcacgatccttttttcgtattccttatggagcacaaaaaaatatcctgttattattagttctgactttttctttcacatgaataggttgaagagctttttggtttcagttcaacatcaacagtattttccaaggattgcagtaaattttttgaattataacggctatgcttcacctatgttttatagcaatttaatattttatccgttaattttttgggctaagttcagcttttcgtacttaactttgtacaagatacctttccgcgctaacattgctgattgttaatctgataaattttaaaaagaatttatctcggattaacgtattcgctactacattgatgattattttctgcttttggatagagatccagcctttaaattacaataaatatagacaagtattcaaaccaattggcttctctaggttagataagttgtcaaaacttaagtacggtgcatatgagtttgatgtcatatatgtgtacagatcagattgcacagcctgtctgaaaaacaagcctaaacttaaaaaatttttgcttgaaaatgaatatgacatttacgattttaatctaactaagacgaagaagaaattgagaccgaaacaatataagcaatttgtgaaacgtttaggtattaccaaggtgccgtcggtgatttttttttcatcccctgataagtatactcatcataattatagacggacatttactgaaataaccagaaaaaaagaattcaaaaaaatgagtgattttttgttgcattagtaattgaatattaaatttttcactaataaatagtcatgattattcggataaggggaggcaattatgatgatcggaaaaactttatggattggtaattggttattctatggcatgggatttatgttacttgctttgataattttaattggagctttcttgtttaaattttttagaaacttatttaaataatcttggagaacataggtaattttcatagtgagtaaaacactggatgttcggcaaacattccataagggtgaaggtaaacatgtatgattagtcaaaatacttttgctgaaaaggtattggaatttaacagagcactcgcgcaaattaatctttgtttgcctgataaatataggctatttaatccctatagtggtggacagaaagaactagttcacaaaattacggcggcgttttaccaaaaaacatttcaatgatactaaacctcgccgattaatactaggaagctcaccagcacgaagtggaacagctgtcacaggagttccttttgaggatgcaaaatatcttcaaaaagaaaccggaatttttattgataaggttcatgccagccaggcctcttcgagatttttgtatgatgttatgcgaaactatggtggtagaaaaaattctacgataatttctttatgagctttgtgtgtccgctaggtttggttgggacaaatgcaaaaggaaatgaagttaattgtaactattatgaaagtaaaaaacttcaagaatatttgttacccttcattgtgagttcactgcgtagccaaatcaaatttggggtggacacatcggtgtgctactgtattggaagcggagaaaattataaggttttaacgcaaattaataacgagcatcacttttttgagaagattattccgttagaacatccgcgttttattacccaatataattctaaaaatatagattggtacatgaaaaagtatatgacggcgttatgccttgtttaaaagtgtgggtctccgagaattgacattaacttaaacgcttgaaacagcaatagcccgctataattggatttaatcaattatagcgggctatttaatttttataaaattcagttacccagagatagtattaaatttttcgaaaataactatgctgaatacttgggaaggtataaatgaatcgctgaacttgttcatgagttaaacgtaattcaatgatgtccaataaaccgttgattgagtcgaccgcttcgttactatattccacggcacccaccaagatatgctcctgatcaaagactaaggttaggccaccatctaattcgttttggacttgtttgaaccagtcatcaccatattcaaaatgctcaactgaatatttatcaggctgtttttcagcctcgttaggattaatacccacttgcgaaattcggggtgaagagaaaacggttgtggcaatcgcaaggtagtgaatggtatcactggtctgatttgtaaacagttgtgccaaatattgtgattcaaaaatggcggttggtgtaatcttcggctgaggtttgtcaaccacatcccccgttgcatagacaccagccacgttagtttgcaggtgatcgtccacttcaataccatgggcattagttgcaatgccaagcgtttcaaggccacttccggttaaattaggaagacggccgctagcgtcaacgatgtaatcactggccaattcaaattggttgggtccgtgtaaaactagcccagcttccgttttctcgactgcatcgacttgttgatcatagaaaaatttaactccccgacggcgtaaatctgctaccaaacgtttgacgtacggctgataaaagtgccgcaacggttgatgactgtctacaaccacgttcacagaagcaccaacggcattggcaatggatgcaaattccatccccacataacctgcgccaataatggttagttgttttggcatttgaggtaaagataagaagtctgtgctgtcatgcagatattcttttcctggaatatccaaacgatggggatgctgacctagtgctaatacaattttttgggcgtgataattggtgtcgccaactttaaccgttttggcatccacaagggtagcgtgtcccacaatgacttgaacgccaccgtcaactaatttctgtttgttgctttcggctaatttgccaatgacttcgtgtttatgcgccatcaagtcgggccaatttatttttggcacgctgtcaaagccgcgaccctgtaattgttcaatagttcgaactaattcaacaggcttatccaacgtgatttttgcgttacagcctcgattagtacaaacgccgccaaacaggccttcttcaataacggctacttttaatccggcctggctcatcggaattgccccattccaagcaccttgcccgctgccaataaataaaacgtcaaacatgtggatcagctcctctatcatttatattgtagattcaaattaacacttccccaaaacacaagcaattgaaacgctttctttcacgatacaattgtgggaggctatgcaaagaaccgtaaaactgtaataatggtgaagttgataatactcgcaaaacagatcagaaaataggagaaaatatgaaaaaaattgcactttcagttatcgggattttggtcattgctgtaaccttagttggttgtggcaataattctagtcaaacggccgataaaacccagttaactgccaaacaacgttctgcaaagcttataaaccgcaaagaaactatctggcgagaaactgcactgatgcagtcaaacgtcgacagaaaaggtaaattaacggcactgaaaacgaaaaagctgacgggtgcggcgagttcgaatttagtttggacgacacataacggccagttttcgagtgggtatacaaagaccaactatgcgacaattaagaaaatgattactaaaaatgcgacgactagtagtgattataagacgaagttgtttacgattaagcaactgaacgatacgttgaaggaagcaaaagcatcgattcgaattcacaaatatagtgatttagtttatttgaaatcaaataaggttgctggtggtcagagtgttggttttattgcgagtgatcacaagctgtatggattgcaactttcttatgtttattcagcaacgcaggccaattctccaaccgatcgggcctatattctcagcgatcaagggtatcaaacacctaaaaagcatgtgaatatcagttcgctaacgggacgatggggaaacagtgatacgacagatcaactgattgttcgtaagcattggatttatcaagtcagtcaaactggcgtgcatagcacctatacccggctaaagttacaggacttgagtaagattaccacagccgatttatatagtagcgctacttttaattatgctcaaattcaggcgctaaaagttggttatgcaatgccacgagcgacaactattgctggtagcgataagacgtacacgtatttagtcttgaacaaaaagacccttgtcagaattggcgaaggctcgttccaacgttataccaaactaacggcagatccgaccaccactgatttaccagaaaaagtgttgcaaatatttaatgaattagatggtcagggtggcactcagattgcggaaacgatgacggccatggggaataattcgtacacaattggccttgtggataacatggatcggttgaccaaaatttcgcttcaacaaaatacaacgattaaaacggcaacggtaagtaacggaaaaattacgattaaaaatgagtgatgggttctgttgccagtttcaattttctcagggaaaccaacccctgatatgatataatgacagcactaaattaagaaatgagatgatgttttatggcaattgtaattacttatagtcatgcggcggaggtacggatagcctagacttatctaaacctccatgattttacggaggaatacaatttattgagtaaaacacaattaaaagcttttggattaacctcagctcttgaggaacaagcaaccaattcgggacttgctttaggccggataactggtcaaaatcggactctatacgatgtgatgactgagcaaggctcacggcaggcatcagtttcagggcggttgaacaacgtagccattgatgctcaagattatccggcagtcgggactggatcttgcttcgaaccctgggatcagtagcggatactgctgtgattgaacgtgtcatgctgcgacgtagtctgttttttcggaaggcagcgggccgcaaaacaaccgcacaaattgtggcagcgaatgttgatacgatttttatttgcatggccctggatgccaattataatttaaaacggctggaacgttatttagttgttgcttgggacagtggggccacaccggtggttgttttaacgaaagcagatttggcttcgaatttggaccaacagattgccgacgttgctgaaatggcagcaggggacaatgtggtcttttgttccgcaactgatgagagttggcgaaaaattactgactatgtgcaaccaggtaagacggtcgcctttattggatcatcaggcgtgggcaaaaccactttaattaatcagttgatgggacgaaatgtgggtgcaacgcaagcggtgcgaggtagtgatgcccatggtcgtcatacgacaactggtcgcgaattgctggtgctacctgagggtggactcgtgattgatacaccaggaatgcgagaactctcgttgctaaatggcaactttgacgcaacttttgatgatattaaacagttggctcagcagtgaaagaattgcttgtgcgagttcatgatgtgggattgaatccagttgattacaagttaatcgaacatcagcctggcagctggctctacccccatattttgggtttagatgtcgcgggtgaggtcgttgaaattgggaaacaagtagataaatttaaaaagggagatcgtgttttttatcatggggatttgacggagtccggtggttttgcggaatttggcactgttaaaagtgacgtagtggccaaaatgccagataaattaacttatccacaagcggcagctttgttatgtagtgcaatgaccgcttatcaagccatctttagaaaggccaatttagaaaatcgacacacagtattaattcatgcgggagcaggaggtgtgggtggtatcgcaattcagttggcaaaaatagcaggactaagagtatttacaacggtttcaaagcaaaaaaaagattttgttgcacacctgcatccggatgcaattattgattatcgaactcaaaatgttactgagcagattcaaagattgacaaatgggctgggggtagatctaattattaacacaattggtgccgaggcagccactcaggacctaaaacgattagcgtataatggcgcacttatagctatcgatgggcaaccaaacttaactaccgattatgccaaattaggtttaggcgtttttagcgttaatttgggtggcgctcatcaaagccataatacccaacaaaggcatgacttggctgttatggcaactcagttgggcgaattagtagtgaaagaaaagttggatccattaattaatcaggaaatttcctatcgcgacatcccaaaaggattacaaatgataaaggatcacaaagttacagggaaaattgtggccaagtttatgtaatatctctaatatttttagtccgtacgaggccgtaggttaataacaaaatattgtctagaaaacaagtttttgtgatgcatatagaggtataagacgactacaaaaaaatttgaggttgacagtgaatttatagttcggaagtgggaaaaggtggcacctatgtgatttttccttatgatattcgcgagttatttggcaaaggacgtctaaaagttcatgcgacgtttgacggcgaagcctatgacgggagcatcgtcaatatgggtatcaaaaatgtagatggttcgattggttatattttgggaattcgtaaagatattcggcaaaagatttctaaatccgttggtgataaagtacatctgacagtgagtgtgataatttaagtaggactagaggcaggtcgtttgcttcagaaatgagctcatgtcataataggcgtaagaaataaacttattgtcagcataagattgtggtttgaaacgacgaaataccattaggaggaattactatgaacaagatgatatttgtgaatttgcccgtaactgacatgcaacgatcaatcaagttttacgaagcgctgggatttaaaaagaatgaagatttttctgatgcaaacggaaccggaatgatgtgggatgacaatatttgggttatgttgttgacgcatgagttctatcaacaatttttacgtggccagttagttgccgatacacaggcagtcagtgggtcaatgacggcgttcagcatggatagtattgaagaagtgaaaaaatttgctcaaactgcgaaggaaaatggcggtgatttttatcacgtggaattaggaatgtctgaagaacagatgtatgaactagaagtaaaagatccggatggcaatattttatcggcggcatggatggctatgtaacttgcaagttaatgtggttatgtttgctagaagctagccgaaatttacggtatacttacagcaaactgaaaacaaggagctaggattatggaaacttttacagaatttattgacacgattgataattctgatcaccaatcccgtgtgcgcgaagttttgcagtgggttagcgatacttttccacagcttgaaaaacgaattgcttggaatcaacccatgtttacagatcatggaacctttattatcgggttcagtgtttcaaaaaaacatctggcctttacaccagaagaggcaggaatcagtcattttgaagatgatcttaaagcagctaatattgatcatacaaaaggtattgtccggatgccttgggaccaaccgtttaattatgaactattgaagcaaatgattgaatttaacattcatgataaagcggccattgagacgttttggcggcctgcaaaacgttaataaaaatacatccacagcctcatgttgtggatgtattttttgattagtgagtatttctgtaccaatgaaaactaaatacgatgataaagattaatgggcctaaaagactgtaaattaagtgaatcataatactgaaatagagactatcggagtcactttctgaagagttaagagcgtcgtccgtcgtatcagcattaacagcaccccatttgtctctttgatgattgtacttataatcagctaagcgattctttgcaccgagttgttgcacagaaagatctggtccaactaatagtttagaaaagcgcattaaataaaattgacaaaaccaagaaaccactaaccagatcatgaaccaattgattgtgaaatgatatttaaaattattatctgcgctaaaaaaatagatgagtaggactgtaaagacggtttgagtaatcatacgagtgatataacgaaaggttttcatcttaatctctccagcaaatttttttctaaagaaagcatagcgcaaattaatcggaaaatcattagaaataattttagcccgagttaaaatgtttgctctctgtttgttgcttggctagaatgactaggtgtcaaatttttgataaaaataagaaactcaggagatttaaattatggcaaaaacatggatgattacaggaacttcaagtggatttggaaaagagcttgcaaagattgttgcgcaggctaccgggactaatctcgttgcgacggcacgaaagctagcagatttagactatcttgatgcctatgatcatggacagattgaaaaagtgttagtagatgttgtggatgctgaccaaattaaagctgctgcaaaacaagcacttcagcggttcggtaacattgatgttttagtgaataatgctggcattggttatttctcaacgattgaagaaagtgatatggcgcaagttcgtcatatgtttgaagtgaatttctttggcctagcaaacatgactgaagcacttttacctaatttccggaaacagaagagtggaacaattgtgaacatttcttcagcattggcgttaacaaccttacccacaatgggttattacagtgctacaaaatacgctgttgaaggttattctgatactttacgtcaagaggtcgctgatttaggaatcaaggtctttacggttgagccaagtggcgcccggacaaactggtctggaagttcttctaagaaagtcgtcccaacaattggtgactacgctaagttcaaagaatccgttgaaacgactgaccaatctgtcacggacgcacctggagatccagcgatgattgccaagattatttttgaccaagttagtgctggcaaagatttgccaaagcatttaccacttggcgagtttgcatatgaggccgggttaaaggacttgactaacttagagacagaaattaagtcccgtcatgagttgtctttatcggcagatcgaaaatagatagaatcatttagtatcatgaaagtgagcgcgaaccaaagcatttaattggttcgcgctttttttaaaagtggaatagcatctgcaagagttggcaaaacggcgaccgccttctcttgaatagttggctgaggcttgatccaatctggtaccaatacgacatctaaaccggcattgactgctgagaggacaccgctggtagaatcttcaaaaacgaccgtccctgttttgtcagcgtgggttctttgtaacgcatacaagtaaacgtcgggagctggtttattatgcggaacttcatcaccactaataaagtcagtaaagtactggtcaattttagtgatcttagttgtttgtatgatagtgtctttggcggccgaagaagtcacgtaacatcttttatgcgtttggttcaaaaattttaagagttcaatggcaccttttttgacctgaacttcaccctgttgaagtcgccgattatataggctcatagcttcgtcaaaaacgcgttttcctaaatctgcactgccaacaagtttggttagtttttggatggtgacgggaaatcctttggcgatgtaggcgacgtgatcctcttttgtgaaggggatgccgtagttttcgagcacgtctctgcgggtttcaaaatataatttttcggtatctagcaggagaccgtccatgtcaaaaaagatgttgcttttatgatttaacaactttcagtcacttcccttcatttaaaccatttagtaaccatttaactttatatcggtagtcggtgactagttgttctggggtccagtcatttacagaagcatcgatcagcgtttcgattaccaaatgcatgacaaagtataaaaagcttttggcctcttcatcagattcaatctggaaatcattggcacttaaaatcgttttccaagcttcaaaaccatgagtttctgggaggcgatgagaaaatagggcactgttttgggtgagtaactgaatttggcgttgcgcagagcttcctttttctaaggtgacactagcgagaagaaaagtttcgattccttcaaagaagtggtcctgatgtttcataatagcttgaataattgtcccgtgaattgtactcgcataataagtaattaaataatggtaggcatcttgcaaatcttcaaaatatttgtaaaaaataccgcgtgacatacctaatgccgtcacgatttggctcactttgacctgactgacaggttggtctgtaaaaacagtgagtaaaatttggcgaattgcttcctgacggttatcagggagattattaaatgttttttggggcatcctctggctcccttcatgaacttgtttactgaaattatagcataatttaaatttaatggtgacaaaatgtcaccggtgcactatagttatttttgtaagtaaaaactggaaggggacttgattcatgtttttagcatggaaagaaatgcgatacgccaaactgcggtatgcgctgattattggcattatgattctggtggcctatgtggtttttatgttgtcaggactggcaagtggcttggcaaacggcaacaaaaaagcaatttcagattggggctcaagtacgattgtgctgtctgcagatagtaacaaggtggcaagtgcttcggtattgaaacgtgccgatcttaaccgcgcgaaaacggcaaccacgaataaggcggcagtgggactatttgcaacggctgctcaaaagagtggcagtaaaaccaaaactaacgtggccatttttggggctcaaaagaggagctttgtggtcccaaaaattataaaagggcgattgtatcaaaatgctcacgaaataattatttcaaaaaacttaagtgatgagggctatcatattggcgatcaaatcaaacttgctagcatgacccacaagtttaagattgtcggcattaccaaagccacaacgtatagtgtggaacccgtaatttatctcaatttggatgcgtttaccacgttgaaatacgggtcgcaaccatttagtagtgcttcgcaaaaaccaattagtttaattgcgattaagcataaaacaccgaaacaagtgaccgtcactaccggcacttcggatacaaaggtcgctaaaatgagtactgcgacattaattcagaatttgcctggattttcggctgaaaaaattacacttaatacgatgatcgattttctgtttatcgtagtggcggccatcgtgggcatttttctgtatgtgatgacattgcagaaaaccgttttgtttggtgttttgaaggcccaaggtgtgcgaactcgttacttggtgggcacaattgtgagtcagtccttcattgttggggcggctggcgtgatccttgcatttattttgggatatctgacaagtttgattcttccagaagcaatgccgtttaccattgatgggatgcagtggctttctgacggcttgattcttattctagtctcgatagttggtgggctattctccattcgaacggtcactaaggttgatccgattaatgcgattggaggcgaatagatatggatgcagttttagaaatgacaaacattcaaaaaaagtttgggacgggccacaccgagtttgatgcgctaacggatgtgaatttctcgattaatgccggtcagtttgtgagtattgtgggtccttctggatctgggaaaagcacttttttgaccattgcaggcggtttacaacggcaaacttccggagaaattttgattaaccacaccgatatcagcaaattaaatgagaaaaaacgaacccaaattcggtttgatcaattaggctttattttacaaagttccaatttaattccgtttttaaaggtgagcgagcaatttgccttggtggaaaaacttgctaaaaaatccttgcaagaacgagtggatatgttgcttaagtcgcttgatattgagaatttgaaggcgaaatatcctaaagaattatcaggtggtgaacggcaacgggtggcaattgcccgagctttgtgtaacgatcccagtgtgattttggcggatgaaccgactgccagtttagattccaaacacgcgtttgaagttgtgaagattttggcgcgggaagcacatgaccaaaacaaagccattatcatggtgacgcatgatgagcgaatgacgaagtggagtgaccaagtttatcaaattgaagatggccgcctttcgttagcagagtaaatggctttaaattttttcataaaaacgagaacaaatattggtttttttgatttcggtccgttatacttactaatagtaaataagaaaagaggaatttttatgtcaacaacagttggattaattgtaggaagtttacgtaagggttcatataccaaagccgttgcagaacaagcagctgcattattgcctgaggattataccgttaaaaatattaatatcggtgacctagatctttacaatcaagatttagatgatgaaaaccaagttcctgaaagctggaagaagttccgtgaagacatgcaaagtgttgatgcagtgatctttgcaactcctgaatataaccgttctgtacccggcgtcttaaagaatgcgattgatgtgggttcacgtccttatggggctagcgtttgggacaagaaaccagccattatcttgagtgtttcgccaggtgctattagtggatttggcgcaaaccatcacttgcgtcaatcattggttttcttgaacatgccagttgtacaacaaccagaagtttacttgggtaatgtgacaaatatcttagatgataacttgaagattacaaacaagggaacgatcggcttcttacaaagtgcaatggatacatttgttgacttaattaatcgatttaaagactaaaaaatattgaattggcagttgtcaaaccagaaaattggtttgaggctgccaattttgtgtttataccgaaacatgtgcgtaaagttgaaaagattacatcaaaattatcaaaagcgaatacattgtgtgcatatttgtatacaaacgattcaaaacttgatatactacttatatagtgatgaagggggatcaggaatatggcaaagagtacaattagtattcgtgtcgacgaaaatctaaaaaaagatacggaaaaaacattagacgatatgggaatgactatcacaacggcgtttacgatttttgcaaaaactttagtaaaagaacaacgctttccatttgaaattacaaatgatccattctatagtcgagcaaatcaggaatatcttgctaaggtaattaaggatatggaagaaaatggtggaaccagccatgagttgatcgatgattaaatcatggtatggagatgcatggaacgattacgtaaaatggcaaacagaagataaaaaggctttaaaaaaagattaatagcttaattaaagatattgaaagacatggttctaaaggacttggtaaatcagaaatactaaaatctaattattcaggttggtatagcaaaaaattagacaagaagaatcggttagtttataaaataaaagacaatattttgtatatagctgagtgtaaaaatcattacaacggatagccatgctgtccgctttttcatttgtagatttttacggcaatggagatccttttactaatcgtctcaatgcactcacttttttaggacagttccttgcggcagttctaactatataaatccgcctagcgtgggacttcatccccctgacggcacctttatatagttagaactaagcaccgcaatccactcactctttctaggacagttccttgcggcagctctaactatataaatccgcctaacgtgggacttcatccccctgacggcgcctttatatagttagaactaaacgccgcaatccactcactttttctaaaaagtaccccggttttgcgaacatacacaaatggccagctcctggcacctcaatcattctcttttccggtgcctgcactcgctcaaaatacattcttgtggcttgcattggcgttatcggatcgtgctctccctggaaaacataaaacgggatcgttatctttgttaaaagacggtcataatcaaaagtgtccagttccacatgcaaactgcgatatgaggcaagcattcctttgcaaaatgccatataatctcgaacaccataatgaggacaccgcaaaatattagggatgaacaaattagttaccatatttgccacatccgttttttgcaatgctgaaaagatattaaattcactaatttgttttgccgaccacgactgcgcatcaaaaggaaacttctgtaaccagtttttacttaaaacatggtttcctgtttcaaacaatgcttggttaaaagcatactgatgcgacttgctggtcatctgttcggttcctatataagctgcgtacaaaggctcggcttgttgcaccatcaagtttgcaatgatgctgccaattgagctacccagtaatataacagggacatttggaagtatttctttaatttttttggtgagcagaatgccatcgtctactaacgtttgtaaatttttggggacagccggttgcttgcgataagtttttccagcaccacgttgatcccaatgaaccactgtgaattctgtggaaaaaagctgagtagccttagtaaacattgaatacgttgaagcagggcccccgtgaatgattaataaaacaggattagttttggattgaccaagaattgtgatccactgttgaatgccattcagttgtacataaccttggtaagaaattcctgaaggattagaattttctacgttgtgtaaaaatagtgccaaaatatcacctccatttatatagaagatatgtttacccttagcttaaaaaggtggtggaaactttgcaatgaaaatgaatccgattactaaaatttggcgtagcgttctgattgacaacaaatattcaaatcgatatagttagctatcgttaatagatgcagattatttgaaaataaaactaataaatgaggagatcaaacatggcatatccacaacttgatttacaaaacgcaaagggacctaaagcaacaattcaaacaaatcatggtgatattgtagttcaacttttcccggagcaagcacccaaagcagttgaaaactttgttgcattagctcaacaaggttactatgacggcattatttttcatcgcgtgattcctgatttcatgattcagggtggcgatcctactggaactggtgctggtggtcagagcagttttggacatgaatttgaggatgaattttctaatgaagtctttaatatgaagggcgctctttcaatggctaatgccggccctaacactaatggtagtcagttcttcatcgtttcaaatgagcatgtacaagcagacatgcttggaagcatggcacaagctggttatccaagcgaagtgattgaagcttacaaacagggtggcacaccatggttagaccaccgtcatactgttttcggtcaagtggaaacaggaatggacgttgttgaagagatcagcaatgttgcccgtgatatgcaagataagcctgataaagatgtgacgatcaagactatcgtgattgaagaacaaaaataaatgaaactaacgtaatgcttggagaaactctaacattacgtttttttgattttaatagaatagaaagaggtcaaattaaaatggaaatcagggaattaattcagcgttcaaccaagattcgggatgcctatcacgctttagaaatgaaacaggacggaaagccatggacgtccgaacaagatgctttagcatttttaagcgatgccggtttggttggcagactggtgatggacaatcaaggtagttggcctgattcggatcaaaactacaaacttgatgcaaaaattgcggagtgtatgtggtggttaagtagtctggctgaagaaaatcaggttgatttggaaaagagcttagataattttttaggagaccgtgaaaagcatttgaaaagttaagatgaactatcgaagggatggcagaaaccatttctttttttatggaaacatagaactgtaacgggtttaattgaatgcaggagtaaaaatcagataaataatcagaaaataagtttattatggttatataactgatataattgactctgttatcgatacggtggaggtagtgtgatatgaattacaaggtaattgcatggggattaggcgccctgatactgatcgttctatttatattctatttagcttattcgaaatatgcacgtcaaaaagttgcgcgtcatgcagtcaatggattggaacgagtgatcaaacgtactcgagttattttaattattttaattttggtgctggctggtgatattggttatggaaaattcgcaccgcatagtagtatggcatcaggtaatttagtttcacggacaggcaaagcggtagagggtttaaaaaccaagatttttggaaattctgaatccgaatcagttgcgaaggttaagaaagcagaaaaagctgaaaaagaaaagaaggcttcttctgaaaaaaagagccatgcaatgactggcgaaaaggcaacagaaattgtcaaaaattactacgctaaaaatggtacggaacaagatgttgaaaagtacagctttattaagtctaaaacgagcactgtttctaaccaaaaggtctatgaagtcggggcttacaagactgagaatggcaagttagttcagattcatgacttcgaggttaacctaaaaggtaagtttgatttactctattaatattacaatttagtaacagtgttaatgaaaaaatcaatgaaaacgattaaaaccgccgttttggcttattgaagcattaattatagccaaaaaagtattgaattgtcttaagtaatgaggtccactgcaaggtggaagcaggttaattattagtacataacgttgtaattatgtgattgatctacggacacaatataagttaattattttcaggaggggtttcatatgacaaagaagaatacatttaagtcagtattatatgctggcgccgcaattgctgcattgagcttaggtactgcaactgcaacaaatgtacatgctgatacaacagcacctgcaaatgctgcatcaactagagtgcacaatcaagtgcatcaactgtttcagctgcacaagacaaggttacatcagctgcatctgacaagggtgctgcacaacaaggtgtttctgatgcttcatcagctgtaacatcagctacatcagctgcatctgattctgctaagacagcttcagacgctaagacaactgttgacgatgcaaagaaagctgctgatccgttgacttcagctgctgcttcagctgcaaacgaaacagctaatgttaaagctgaatcagttgcagatgctgcaaacttatcagctgcatcaagtcaatatactgaagctaaagctgcacagaactcagcttcagaaaacgcaaacagtgctgctactagtttatctaatgtcaatgctgaagttacagctaacgaaaagaattatgcaaaagataatgcagttttatctgatgcaaatactgcattaaatgatgctgaagttaaatatagtactgcagttggtgcttcaagtgctgcagaagcacaagttaatgctaaagaagtagcatatacagaagcttctacagcatataataatgcacttaagaatcctaacaacaagcctgctatcgttcttactgctgcaattcttaatgctcaaaagaaagcatatttaaatgctcaagcagagcaaactgctgattctgcgcttcttgacgaagctacaaagggcttgacttctgctcaacagggccaacagacagcttatgatcaacttgcttctgatgaaaaagcattgaagctctcaaaagaggcacagaataaggctagcgagaatgttaatgtcactgctactgccttgacaaaagcaaatgatgctgtaacagctgctgaagttgcatggaacaatgctaacaaagaccttgctgctgcacaagctaaagaagctgctgctaaagctaaagcacaagatgctttgaacacatacaacgatgccgttaaggtatacggtgatgctcaagcaaacgctgatgctgctgctgcagttacaactgctaaagaaaaccttgctgctgaagctaaattggctgcagctgacaaagctttatctgatgcagaagcaaacttagctgttgctaaggctggcgaatctaaaggtaacggtggtgtgaaagaacacactgactttgttccagcagtacctggtaagaagggtgttactgtagctccaacaagcaaaagggtggttcaaacactggctctaacgttgcaagtactaagagtggtgttgttgcttcatcaacatctgcttcaggcaaagctgctcctaaagcagctgctgcaactacattgccacaaacaaacgaagcaaacagtcaagttactgttcttggtttgttaggtgcaatgggcgcattgttcggcttagccggcacacgtcgcaaacgtcaattctaattaaaacttatcaaatatcaaaaaagtcgatcagaaatgatcggctttttttgtacataaaatgctatagtaaacttatggaaataactatcgaataatgaagtgaggtacaacgatgacgaaaacattatatttaatgcgccatggggaaacggtatttaacgtgcgtaaaaagattcaaggctggtgtgattcaccgttaaccccaaaaggaattcaacaggcccaaaatgctagtaactattttaacgatattaacttagatcacgcttattgttctacctcagaacgagcctctgacacacttgaaattgtgactagacataaaatgccatacacacggttaaaaaggtttacgggaaatgaactttggtgcctttgaagccgaaagtgaagctttaaatccaaagtcgcatgaagcttacaacacattctttgtggcttatggtggtgaatcaaccggtcaagtcacgcaaagaatggttaaaaccctcacgagcattatgcaaaaaaatgatcatcaaaacgtcttagctgtttcgcatgcgggtgcctgtgttaactttttagcaacctgggaaaatccagaagaagtcttgagtcagcgtttcaccaattgtggaattttgaaattcacttatgataatgaaaaatttaagctagaagaagtgattcaaaacataaactagaccaaaaaatacgtattaatcttcagggtgatagtgacgctctggtagtttgttactgattcgttggcctaaagaacggtcacgcaactcttggtaatctttcaaaagcgcttgtttgtcagcgttcaatgaagcaactttctgttgtaaatgaatatattgttggggatccaagtttttattttgtaactcaagctttttagcttctaaatcggcattggcttgatcatattcttttgtagaacgagtaatttttttagacagatcagtttcttggcgggttagaacttcgaagcgcgaatacaggtttttaataatctggttatttttaatgatttcagcttctagagcttctttttgttttgataattcttcaattttttttgaagtttctgcttcagacatgggattcagcctcttttcaaatgttaatgtaagtacacatatcataactctttgcacgatttccgtcacgtttggaatagaaaattactaaagttatgcccagcatttcattttagctcgatttccgttaagatagataggtagatcttagagaaggaatggcaaagtatgacaccagaaacaattttaaaagaaaagtttggctatgattcatttcgtgacggtcaaaaacaggtcatcaatgatattttaaatgatcaaaacgttttggctatcatgcccactggtggtgggaaatcgctttgctaccaaattccggcaatgctatttgatggcctaactttggtgatctctcctttgattgctctgatgaaggaccaagtagatgccttaaacgaaaacggaattccagcgacgtttattaatagtagtttagataacatggaaatgaaccggcgttttaaattggccgccgatggtcaggtgaaactcctatatattgcgcccgaacgattggattcaagttattttttagctcaattacaagaattggatattgcgttagttgcagttgatgaagcgcattgtatttcacagtggggacatgattttcggcccagctatctgcgtttaaccgacacactcggtcaattacccactcatccagttacggtggcactgacggccacagcgacgcctaaggttgcccaagatatcaagcatcgattacatattgaggccgatcatgaagtgaaaactgattttgcgcgagacaacttgtcttttcaagtaatcaaggatcaaaatagtgaccagtttttattggattatttgaaagccaacaaagcagcggcaggaatcatttatgccagcacacgtaaagaagtagaacgactaacgaaattgctgaagaaacgcaaagttagtgtcacaatgtatcacggtgggatggcggagaatgatcgccgccaaaatcaagaagattttttgtacgatcgaaaacaagtgatggtggcaaccaatgcatttggcatgggaattgataagagcaacgttcgttttgtgattcatgcgcaggtgcctggcagtttggaagcttactatcaagaagctggccgggcagggcgtgatggcttacccagtgatgtgattttattattcaaactccatgatgtccagattcagcactttttcattgaccagtcagaaatggacgatgtcaacaaacggcgtgaataccagaagctacaggatatgacccagtatgcaaatacccaacagtgtttgcagcagtatatcttgaattactttggcgaagatgggcctgtttgtggcaagtgtagtaactgtttggatgagcgcgattcacaagacattacggtagaagcacaaaaagtactgtcatgtgtgaagcgaatgcatgaaaattttgggaaggtcttgattgcccaagtattagcgggatcaaaaaatcaacggattaaacaattccactttgatgaactaagtacttatggtttgctgaaaaataaagctcaaaaacagctgacagaattaattgacttcttagctgcttcagggtaccttcaagcgtcgaacggccagtttccggtattgtcaattgcgccggctggtgttcgcgtgctacagggcaaagaacaggtatttagaaagatggcagcaccggttaaaactaatatcttggaagacagtgaattatttacaaagttacggatgttacggcgttcattggcggaagctcaaggtgtgccaccgtttgtgattttctctgataaaacattgcgttccatgtgtgagttgatgccccaaacacttagtgaaatggctgaggttaagggtgttggtagccaaaaacttgaaaaatatggtcgccaatttattgatgttttgcagagtgatagtgacgtgttagaaaaagcgacagaaaagtaaatcggcagctcaaaggaacatgagttttgaacgcgtttcggctataaaaaataaaaaaaagttgaggaaatcttcctcaacttgtttttttaatcttcaagggtcaatttagcactaccagaattggtattaccagtgaccttatattgtggacgatcaccgacatgtcccgtttgataagaattaccactatgttcaaaaacgacatttccgtcaacctttgcacggccactttttgtctctaattcgaaattgaagatttcagagtttggcaatgtcagtttgacggcaccactatgcgtattggctgccacatcaccattaagatggtcaaagttaagcttgacagaaccactgtgcgtacgaaaatttccggaaccatttccgtgggtcacacggattgaaccactgttagatttaagattcattaaaccattaaccgaatcaaacgaaacggaaccgctatgtgaaagactagctagtttagtggcctgaatgttttcgccatgaattgatccagagaaagcttccatattaagctgggaaactttgactgtttcggcacgtgtactcccagaatgagaaaccacatttaaattgagctgctcatttttcaggtcttgaacgcgaattcgcccatcttttgtgtccgcgtttaaagttttggtgtaggttgatggcactaagatctctactttaatatttaaatgccagagtaggggctgatcaccctgacggattgtgagttcgtgatcagtgacgttgcttcgtaaatagtagcgatcattattacgactcatgtattcattcacaatcaattgatcgccatcagtttgtttaattgtgagtgaggcacttttgtagttaatagcgatgttcgtcaagtcttggatcggaaaagcctgcgaatttacgagtggcaaggattccatatataccttggaaggcgttttgccattaatcgtgacatcaccgtcagtcactttgataaaaccatcgccaatatctacattgtcgccatctactttgagaagtttgccaatttcaactttatcgccgtccgccaaagtttggttgcccagtcgaactttaccatcttcaatatctaagttgccaatgtgaacactattgcgattgtgaccctcgtgtgagtgaccttcatcttcatcagcattgtgttcgttggtaatttcttgaacgagttcatcaaggttccctagacgatcaaacaccgcttgaatggccttatcttcgtccataccatccgcgacattatcgttggtagcttcggtgaggtcggaaacaagctcttctttgagttcggtgagttctgtggaaggggtatagttcataaataattgatctaattttgtgcggacctttgtttcaatgtttgtcatagtcgatacttcctttaattagtttttcaataatcgtttttgaaaaatcccattgttgtacattctcggtgagcaactgttggccgctatcagtaattcggtagtatttgcggcgggcaccttgagtttcatcgccccaataactttcaatgtcttgatgcttttcaagccgacggaaaacggtgtagagagtagcttcgttaatttcataggcgtcatcgctcaaatatttaatttgtttggcaacttgataaccgtagctatcttgctgactgagcagattaaggacaatggtgtcagtgttaccccgaattaaatccttagaaatttgcataaattggtggacctcctttgtaacttttttgattgtctaaaatgtatcacatattactgtgtgtgtgtcaaagtaatatgtgcaaaatagtaaaaatacaaaatgattggctaaatggatgaaatgtggtataaatagtaatcgttactattaagaaaaaggagcaagtaaatatgacaaaaacaatggatttggcgacagcttatcgacgattgaagagtccgagtttgaagacaaggaagtctgcgctccggacaatcaaggcagcaaaaaagcaaaggaagggaaatagttagatggcaaagaaatcaaagattatgaaggaacaaagaattgaggcaacggtggcgcggtatgcgaaagtgcgcgagcagttgaagaagaatcatgattatgagggattaagtaagttaccaagaaatgcgtcaccaacaagaatgcatagaagggatcatttggatgggagaccgcatgcgtatttgagaaaattcgggttgtcgagattgaattttagaaaattggcgcatgaaggccagattccaggagtaagaaaggcaagctggtaaaaaaagtgcggaaaaagacgattagactgtgagcattagcataacaccagggattgtccatgggttgagtggacgatccctggtgttgggctaactactccgctattgaggttgcttattagctcaaagcgctaataagtttttttgctccggacgttgaccattcttgtggccgaaaaacagaccgcaagaattatggcagcggaagagtctgctttttggagcacgtttcagaaaaaaagtttggtgttaaaagggtaaagagaatgtcagaatggtttaagaagcaagtaataagcaatagtggtttggtataagaggataacgtccagtattaaaaataagaacgtaccaaaaaaacacgcattcccaatgtccagtagatccagaacgctggatcaaaacattgagaatgcgtgttttgttttacctaaaggggaaaaacttattgttgattttgttcaggaactttaccgagactaacatggcgtttgacaaggtaacaaccaacgccgagaaccatgccaactaaagcaggaactacccagtccataccgtattgagcaaagggaagataggattgttgaaaactagccattgcttttccaagaccgctttggctgacaactggaggaaacgcagccatcatgtcgaataaagcaggaacaacggtgaaagtgacaacaaatttgtaaacaactgaatcgcgatggaacagtggtgaaaagacggaaagtaagatcaaagccatggccaagggatacaagaacatcaaaacaggtgttgaccaagcaatgatttgattcaaacctaagttagcagttaaaaacgatgcggcactggtgaaggccaaccaagttttgtagctgatctttggaaaatgtttgtgaaaatcttgagcaaatgcggcaaccaacccaatggcagtcgttaaacaagttaaagtgattaaggcggctaagattgattgaccgacgacacctaagtagtggttaacaatttgatcaaaagcaacgccaccattggcgctaacggcaaatttaccaagcgacattgcacctaacaaaattaaagctaagtagatgatcgcttcaaaccccatggagaaaagaccggcgcgggcagtgacaaaggcgatgctgttcgcatttttcttacccatgaatttgacggccgtgaccacagttaccccaaaagccaagcccgctaaagcatccatcgtgttgtagccttgcaaaaatccgtttgtgaaagcaccggttttataggcggttgtgacagcttggctagcagttgagccgagcggacggctgaagcctaagaagaagacaaagacaagtaaaactaagaagactgggtttagtaatttaccgacattggaaacaattttgctttgttctactgaaagaaaataggcaagtgcaaagaaaacggcggagaaaacaactaatcctaaagtctgcaaatgggctggcacgagtggagcaacgccaactgtgtaagaaacagtggcagtccgtggggttccaaataaaggaccgattgtgccatgaattaaaaccatgaaaactaaggcaaatacagggcctaaaggtttacctacgtcgtaaacgccttctgaatgggtaatactgattgctagaactgataaaagtggtaacaagaccccggttactaagaaaccaagtgcggcaggtaaccagttcgcaccagccaactggcctaaatgaagcggaaaaattaaatttcctgccccaaaaaataaagcaaatagcatagaacttaccaccacatagtcttttttcgttaattttctttcttccataaaatgtcactccttcataagatttaaatcttatgagaaaaagctaaaagaaaataaaaacgtcctcatcagaataattattctgacaaggacgttataaacgtgttaccacctttgtttacagaaccatcactgattctgccttttcgagtacgcaatcatactctagctctgtaatgggagcacccaatgcttactcaaatttcgtaggcatcgctcaaagatgatgttctggaaaaatcctttgacgtcctttcaccaaacgacgctcgctttgcaatggataatttccatactttcttttcacagcttttttctcattgatttataatatgggcttaatttactctaataaacaacttctgtcaaggccaatttgaaaatctattgaaatgtaatgtaaataaaaaattcaaccacttaaaaagtgattgaatttttttaatggcaaaaagccgattatttaacttttggtgtatctacaatttcttcagtcttgcctttagcgaaacgttggatagcaacgattcgcgcttggcgacggcgacgttcgcgcttaccagcaactggacggcgttttgcgaatgagttatatggtgatcgcataatgttcctcctaaaaaataagttattactattgtaatcttaaatgcccctaaaatgcaaatgtattttatgaaaatataaactaatacatgaacgtaaggatttattaatcactcttttaatctttagtaacgttgctgcaacattttataggtatgattggtaacaacttaaacaaaccatgaagggagtcatttatgattaaaagacagcaacgttttgttaactggattgaaaaacagctcaaggaccaccaaacgcaaccggaaaatttatttgtcactttcggttatttgaatcgggtcatgggtgccctggaagacaagaaagctgtcgccaaacattatgacgaacggacagtaaatgtggcccgaacgctaatgaagatgacaaatgatgagtttctcaatgaaattgctaaaattgaatatgcgccggccgaactttcgagtgatggtattcaggtgttacggtggtttaaagaacgtgatttaaatgatcaaggtaatttggtaagtaatctcggttttttgacagaaattgtgaatgaaacagatcagtcacagatagcaagttgggatcgccaaacggttaaagtggcacgaatggccaatcatgttagcaatgatgagttgattgcgattatgttgaattgccaatcgaaagcaaagtatgaacggttatccgtatcaaaacggacaacccattatgcccacttcttcaaaagaaatagtgtacacaaaagctttgggtcgtacggagagtaaaacaattttttcagatggaaagaatctagcgtaataagctaggttctttttgtttaatttagataatctgaacccagtaaatgaattatcgataattaaaagtcgcagtcgttttaaaagcaggttataataatttagtatgaaacaggtggaataaaggagggaagcggttatagcttatgaaaattgatcgtatgcaagcttttagtgatggggtttatgcaattttgatcacgattttggtgttggattttaaagttccagactatcatgcgggtagcttactgatggccgtgctacgacaatggccgacaatgtttgcgtacattgtttcttttttgtatgttggcacgatctggctttttcatcacgatttttttcaaacgctaaaggaaaccaatacggggttgaatgttattaatttggtgatgctgttttctgtaaccttgatcgactacccaaccgcattggtagctaacacattaatttcgcaaaatcgcactgatatgcaggtggcatttgtgtattacgatataatcgcgttgtttatttcattcacgtttgcctggctgtacacgtatgtgcgcaatcatccagaaatgacacggatgaaaagtgatcaacccacttttcatcaggccattaaatatgatccggttcgtagcgttttaatctatggtgccgcaattgtcgcaactttcttctcaatttggctaggtgcatttttacttttagcaggtgtcggctatcattttgtcgcttacctgcgattaagtaagtcaatgcaaaaaagcataagagaagccaacaatggagaatataaatgattattaatttacaaaacacaaccgaagagccaatgaaaattagagcttttttgaagtcaaagggatttagtcaccgcctgattagtagtgccaagcacgaaggcatgatgagaattgaaggtcataaagttagtacaactgacaccctggaggctggggaaaaattaaatttgcagttaccaaaggaaaaatcggatcctgaagttccattcagtttcgaaccacttgaaattgtgtttgaagatgaaaactggttagtgattaataaaccagctggtttaacatctgttccgggccccagcaatcgagaagacactgttgtaaatcgcgttaaagggcatttaaagaataacggcagtaaagatttaattccgcatgtcattacccgtctagaccgcgatacaagtggagtgatgctaattgcaaagaatcgtttggcggtcagtgttttagctcctcaaattgaaaatcataaaattgaaaaaaagtactgggcatttgtcagcgggacaatggcagaaaagaagggaataattgataaaccaattgtaagatccgaagatggtattcatcgagaagttaatcctgaaggtcaacaagcaaaaacacgttttcaagtgttacgtcaatatggcgactatgcgttagttgaagcagagttgttaactggtcggacacatcagattcgggtccattttgcgagtttaggacatcctttgttaggtgatcaactgtatgatggtcccatggagatgggaatttctcgacaagccttgcacgctacttctttaaaatttgtggatccgttgacagagcagaagcatgaattcaaagttgcaattcctgaagatatggagaatttgaaaaatgtttaaaaatgaaggattgccaggaaaaatcctggattcaaagcaaatctataaaggaccaattttcacgttaagccaacaaaaaattaagactccagatggcttaacgatagatcgggacgtcattttacatggttccaccgtcacaattttggcatttacacccaaccaacatgttttattaaatacggaatatcgagttggggttaacgcagaaagtttgtcattacctgcaggcttgattaatgaaggagaaacgcctttgcaggctgctaaacgggaattaattgaagaaactgggtatcaaactacgaaaactgaaattatgacgacttcaacggtatcagcgggattttccaccgaaaaggtaacgctaattttggcgcaaattgaacctcaaaaaacagaatctcaacacttcgacagtgacgagtttgtgaatagtcaactgattcgttatagtcacttgaaacaattaattgcgcaaggtagaatccgttcctcacaagccattgcggctgttggttactatgaaatgttttgtaagaataaatagacatttttcatatttgcaaactactttacattttgatggtcttcccgtaacctattaattagattaaaggaggatttttgtgataattatacgtgaagctgataaagatgatgccggccagatagccccattgattaatattatttatgatgaaatggagttagatgagctggatgatgtccccgaccctgtctggatgcgggtgttacaacgcgcataccaaactgacgcctataccggtgaaaaggctacaacaattgtagcggaggatcaaacaactggtaaagttgtgggtgttgcatttggctatcctgatcagtatgaagaagatctggatgcaattattgaccgaattaccctcaaggcaaatatttttgatggtgatgtgctggatcctgatttagaagcctttaaaaatgagtggtaccttgattccattgcggttgatccaaattatcaaggccaaggtattggtggccgattgttgcgctccttgccagagtttgtgcgtcaagatggggatacaattattgggctaaatgtggatttcaaaaatccgaatgccaagcgattgtatgcaagacatggctttaagaaagttgggacaaaaaggattggcgatcatatgtatgatcatatgcaaaaaccaattgtgacaacacaacctgttttcgcttagaaattaaaattaataaaatgaggtaaccgaatctagttttctggattcggttttttaatagtacgtaattctttctggtctttgtaagtctcttggtatcttttacgccggttttattataaaatcaaggaagacaataaaattaaaaatgaggtaaacaaattgagtaaagataatgatgagtaccaagaagttgaattagctttaggcgacaaaaaatttgaacaaatgttaatggttttgaatcacggtatttctaagaaaaatgccagtgaatataatttcaatggcaacgacatgcaagaagttggtgaaaatgtttgggcagttccagcttatttagcagacgattattctctattcttcttatacacccaaattgatacaaaagactgggttgtggcttttgcggaaggaaaaatgcaaaccgaacagtttgaacttggtttaccaatgacaactggtaaaggcttgaacgtgttggcagaaaaagatatggatcgggcacagatggtcactggttttgtgaatgatatttccaaagctggcgaaggtgaatggcgcatgattgatgaaggcaacgagtcagaagataaaaaagactaatctttgaggcaatctagatgaatcaaaaagttgttcggtatggcattatgggggcagcttccattgtgccacggattgtggcaggcattcatgaatcgcccaatagtgaagtggttgcgattgctgcacggagtttggcaaaggcgaaacaggctgcagatcaattcaacattccacaagcatatggtagctatgtagaactttgcgaagatgacaatgtggatgttatttatgtgccattatggaacgcaggccattattccggtgccaaattagctttacaacaccataaaaacgtgttgctggaaaaaccatttacgctaacttatgtgcaggcaaaagagctttttgcgctggctaaaaaacaagggtgttttctaatggagggtcaaaaggctgcctttttgccaattacgttacaggtacgcgaccaattactaaataaacaggctattggtaaaatttgcgccattaccgttcaagaatcacaccctgggatagaaaaaattccgtggtttcatgatgtaacggtaggcggtggtgccttttacggaagcgcatcatatagtttggaatatatgcaattagttttacaaactgagattacggattatcaaggccaggttagtcgagtaggtgtacaggcagatgatcaaacgcagctgaacctcaagttgggttcgggtcaattggctagtattttcatgacaacgctaagtgaacaagtgcctagtcaaatgactttttggggaaccgagggatcgttgatggtaccaaattactggaaaactgactcctatgaactaaaggttggtaaaaagattcaacaaataacacatcctcaaaatagtgagttcgtatatgaattcaaccatgtttctgagcaaattttgcaaggagaacagtcaagtgatgtgatgtgtcctaccgttaccttagcaaccatgaagattattgatcgcctttatcatcaatggtatccggatcaaatgaaaaagattcgttaacttatggctttttacttgtgagttggttttaaagatgatacgctgttgactggggtagggttcgatctaagtgccaagcaatacctgcaatatcggtcgattttttggatgggccgatgcttatcatgttgcaacgtttttaagaaaaaagttttgtgaaagattttttaattagacgcgtacaaatacgctttgactatgcttcctactgaatcctagaaagcataaggaatcgtaattgaaacaatatgtaccttgaaactttaagtttttagattggcgtttagatctatccccaggcacttttcaagttgagcaggttcttgaaaggtgctttttgttttggctacaataagtctgataatttattaaaacgttaacgaaaaatcaaagtggcgggtaaaaacattgtgatataatgataggtatgaatttaacgataactaaaaggagggatttcagatgtttgttgtgagtatagttgctttagtgattgccattacaattggttttgaaattcgaaaagttgaacaccaacgacagttacgcttggctcacgaacaggcgcaacaaattctgaatgatgccgaaaaagcggggaaagtcgaagcaaaacgagccttaaataagggcaaacgagaaacgcttgcttaccaagaatcaattgaccaagaaattacgactgacgtccaagacaatgaacgcaagtcaaattggcttgatcaacgtgaccaggttttaaaagaaaaagaagatcttttaaatcgacggtttgatacatttaagagtaagcaagaaactgttaaagagaatcgtcaagaattaaaggatgtccgcgcacaagcagcagagctaatcacaaaacgtgaagatactttgcaggatgttgcggaaatgagtcacgataaggcgcaagattacattttggacgaaacaaaacgtgatctgaaagaagaaggcaaacgcacagttcgcaatgcggaggctgagtatcaaagcagtagtgaaaaagaagctaaaaatttaattgcccatgcaattgagcacagtggtattcgttcgcatatttttccatccaaccgaacgatggatgtgccgtccaatgaggcgttaggcaaaatcatcgggaatgctggtcaaaatgtgcgagctttagaggcgttaaccggaattgatatcaatattgatgatcaacaacggttaattactttagacggatatgatcctttacgtcgtgaaattgcaaaacgggcaatgacccagattattcaagctaaccgcattaatccagacattgtggaacaaattgtgaaccaaaccgttcgaaccgtggatgagctgatccgcgggtttggcgaacaagcaattaatgaattaaacattaaaaatattcatccagatttgatcaaatttattggtcgaatgcatttccgaacgagttatggccagaatattttggatcattctattgaagctgctaatctagcaggcgtgtttgctgcagaattgggtgaagatgtggatttggctaaacgtgcgggtctcttacatgatattggtaaatcaattgaccgggatgtggaagctacccatgtggaattaggggtagaactcgctaccaaataccacgaagatcccgttgtgattaatgccattgcctctcatcatggggatgtcgaagctaaatatgtgatttctgatttagtagctgctgccgatgcaatttctggatctcgtcagggtgctcgtagtgaatctgctgctgattatttgcaacgaatttctagtttagagggcattgcaaataaatatcctggcgtacaggcaagctatgctattcaagcaggacgggaattacgagtgatcgtcaaacctaatcaaacttctgataagagtatcgaaaaacttgctggaaatgtgaaagatcaaattgaacaagaagttacctatcctggacaggtaaaagtaacggtcgtacgtaaattacaggttgtagagtatgcggtgtgaaatgaaaaatttgacaaacgaagaacaagcaacgttggaagctattgaccaatttgtgttttttaagttaaatgatgatagaacaggacatgattatgcacacattcaacgggtcgtcaaaatggccaaacggttggcttccgaaactgaagcaaccgatttgtttatcgttttggcaagctcagaattgcatgatgtcattgatgaaaaaattgtggacaatcagacgactgctgaggcggaagtgaagcagtttttacaagatcaaaaagttaggactgatcgaattgaggccatttttgatattattacccacatgtcgttttctaagaatcttgagcatcattataagttgaagttagagggtcaaatagttcaagattctgatcgtttggatgccatcggcgcaattggaattggacgggtattttattatggtggtgctcacgggcacgtgatgtatgatcccaaaattgctccgcgagacaaaatgacacatgcacaataccgccaaaatgaaactgtgattaatcacttttatgaaaaattgttgaaattggctgggttaatgaatactgatgccgcaaagcagattgcggatcaaagaacgactgttttgacggattttttagacgagttcaaagcagaatggaataaaaataaataatttggagtagattatgttaaaaaatcaaaactcaatttcgactagatacgcgtggatgtcgggattaattttcgttttattgttgttggcaattaaggcaaattctgccttactgttaaaactagatacgggtatcattggcattgtgcaagactcgttacctgaatttgaaacaacattaatgacacttgtttccaagattgcagaaccgtcatttgcgattgtttatgcggtgatcattgcggctattttatggtttatgcgtttgcgagtagatgctatttggacgttagccacgattggcggaggggacgtcgttgcgtacatatttaaagaaattgtgcaacgcgcccgaccaagatggaatcaaattattccagaaagtggttatagttttccaagtggtcatacctttggggctgtcatcattgttttctttatcctgtggttctttgtcagccaaatccgctcgacaaccattcaaaaggtgagtcaaattgggcttatcatctgggttgttctggtgatgtattcacgaatttaccttggcgcacattatccttctgatgtatttggggcattcttcttagcggtggcttggttagcaattgcccgctggttgtataaattgttgtataactttgtagcgaaggttgtagaacctaggtctgagggaagacacagtcaacattaaaaatctgtaatttaagagcaggcaaaaactatgtttttgcctgctctattttttcgttagtagttgcctttaatgacgaagaatgagccacgaataacgcctgccagtttggatttttgatgggcaaacttgaacttgccctcaaattctttaggaacatccataccttcagagagtttaaaacccacagctcgttttccgtcatcagcaatactgtacatgacattaacgactagtccattttcgtaaaaaacataggccattttgatcccttcaacttcaaaatgggtgacttctaaaggtgtagcagcaaagtgcatgtctcgttctgataaaattttttcaatccagacaagggtatcaggatcttcattagcgggaacggtggtaaaaacgtgtttatatttattccaataatatcgagcttcgtttgcacgtaaacccgctaaagcaggtgcaactggtgagctttctaatccaacggtggaaacttccttgaaatcaactttgtaaaccacttggggttacctcatttctatatttacgtacccatagtatataaagttacaagaaattggtcaatcaaaaaaacgcgtaattttgccgtttttattaaaaaataggaataatttatcaactcaaccttcaacctattcaaatacgttgtaattaatcgtcatgattagataggattgtggtaaaatcgacagtatcaaaaagttttgtgggaggtgaaatcttgacatttaatttaacgattctttcaacgagtgacgtgcatggatttgtctatcctaccaattttgtaaaacgtcatttgaacttaccctttggtctcttgaaggctgcgcaagttattgaaaacgaacgcaaaaatgcgacaggacccgttttaactgttgacgcgggggatgttttggaaggatccccactgactgaatacctggctaaatttagtacgccacctgcaccacaacgtttgctaagggcctataatgccattggttatgatgtgggagtgttgggtaatcacgaatttaattatggattggattatttaaaaaaagcgattaaaagcacggattatccagttttatctgcgaatattttggatcagcaaaaaaattcaattgcgaacggtgcttatcgaatttttgataaacaaggcgtgcgcatcgctgtgctggggttaacgacggcttatattccattttgggaagatccagttcatattaagggactacaatttaaaaaagttttaaaaactgccagacattatgttgaagagttaagaaaaaaagttgatgtcattattgttgtgtatcatggtggttttgaacgtgatttaaaatctggtcaagaaacggaatcgttacgtggcgaaaatgtaggttatgaattgttgaaaacagttaagggcattgacgccttagtttctgcacatcagcatcgattaattgcaaccaagttgtttggtatcccagttgttcaagcagggcatcgcggtgcagcagttggtaaaattacgttgaagatcgatccgcagcaaaagcatatggtcgttggggccagttcagaactgatttcaacgggaaaatctccattacataaaaaaataaaggcaatcatgacggatgtagagtccgatacacagtcatggttggatcaaccattgggaaaagttcaaggagatatgaagattacggatccttttaaagctagagttgaggaatcggcgtttattgaatttatccaaaaggtgcaaatggcggccacagggacttctatttccgctaccgcgctctttaacaatgaagcgactggttttgatgaacaaatcaccatgcgtgaggtagttaccaattatgtttatccgaattctctagctgttttacgagtttcgggcgcggatctgcgggcagctctggaagtgagtgccaagtatttcatgattaatcaacagggtaaattaattgtgaatccccgctatttatcacccaaaaaacgttattacaattacgatatgtacgaaggcattgattacacattagacatttcaaagccagttggcaaacgtgtggttcggctgatgaacaagggacatgtgattgcgccaaatgattcgttcgaaattgtgcttaataaatatcgagcggttggtggtggacactatcctatgttttctgaaggtaagataattcgtgaaaatacggaggctatgtcagagttaattgccgactatttacagaaacatcccgtgattacggcgtctgtgaacagcaattttaaaatcattaaataaagaacgtataagctagaaaagtgaattttctggctttttttgtaacttgaatcaacgtcctcgaaatctaagttgtttggaagctgaccaaggcttgcgtagtgatttattttagttgataattagcacggagggggagatacagttgcataagaattcgaaaatgagtgggatgcgtttcttacttgtgaccgttttaaatgctttaatcacagtggtcgaactttttggtggtgttttgtcaggtagtctagctttattgtcagatgcatttcataacctgggcgattctgcatccgtcgttttggcgtatgttgcaagtcgaattggccttaaaaattcaaatatgtccaaaacattcgggtatcgccgggcagaaattatttctgcatttgtgaattccgtatttttaattgtcgtttcttttttcctgattattgaaagtgtacggcgaattttgaaccccgagccggtaaatgggggaatcatgttgattgtggcgattgtcggaacactggctaactttatttcagcattgctgttgagtagcggtgcaaagggaagtctaaacataaaagcgacctatctccacattttaagcgatgcattgtcatcatttggaattgtgattggagccattattattcaggtttggcacattgatattgttgatccgattgtgacaattttagtttcagtctacattatgtgggaaacttggcctgttttaaaagaagcaattaatattttgatgcaaggtgcgcccaatctagattttgaagctatgaagcacgatatgttgcaagagcccggggttgtcaatgtgcatcacattcatgcttggcaaattgatgaaaaccggattatgttttctgcacatattaatttgaacgatcaattattgagtgatgttgagcctgtttatcggcatttagagaatttattgcaaaaaaaatatcacgtagatcacgtgactttacaagctgaagtttttcgtggaaaaagtaatgaactatttacgcgtgatcggcatgatatttaatgccagttagtgaggcttaactttcgctcacaagctgtttgtgatgggagataaaccaagtatcccaaggaatctcaggagttccggtaagattatacttttgatcaagatgctccatgacctgaatgtagtcgttactggaagtggctaggcttaaatccaacaaattggcatgggttaaataacgatttcgggcgataaaagcgttaatatcgctaagataacctgcgggaacaaacgacgaaataatttcgagactttcggctttatagagtcgaatgtaaaactgtgcaaaagatcggacggctttagcctgattatccgaatctaattgcgtgatggaaactaaattactcataacagcccttcctaacttaacttattacgtcttaagtatagaccttaactattaaaagtgtaaaattaaagtttggggtaccttagttgtatttctgattcaaatgagttataaaagtagtattaacaaaatgaggtgaatagattgaccccgatgaaggaagactatcttaaaattatttttgagctaggcggaaaatcaaagaaaatatcaaataagcaaattgcaatgggtctgaacattgcagccggttcagtaactgagatgattacgaagttagttgaggaaggtttggcaaaacacacgccttactctggaatttcgttaactgacaaaggtattcaaattgctgaaattatggtccgtaagcatcgtatgtgggaaactttcttagttgagaaattatcctacaagttatctgaagtggatgatgatgcagaagtattagaacatgtgacaagtgaaaaattgttggattctcttgatcaatttttaggttacccaacacactgtccgcatggtggagtaattcctgataaggaagggaactatcaagaagatagtcatactttgttagcagatgttaaagaaggcagtacggtggtagttgataggtttattgataatcgtgaacttttaaattatttggatgagattgatttagatattggtgataagattcaagtgattcaccacgcgccgtttgagggtgcaacgactgttaaactgattgataatgaatcaaaagttgatgaacgacaaatcagttataaagctgcccattatgtttttgttcaggatgactaatttttctaaactggcttttgtgattcacgaaaatcaaccgaaagttgtatgtcagttaaaaagctgttatgatagccatacggagattgatagccaattgaaaattaagaaattaaataaataaggacttaattttaaaagtgggtatctttttctaaattgatatggtacaattacattgtattttggttaggtaattttggtaagatcgtttcataaagaaatatccccaatttgcaccggatcaagtattaaaatatttagtgcaaaaagcactcaggaggattttctattatggaacatggtacagttaaatggtttaacgcagacaaaggttttggttttattactcgcgaaaacggtagcgatgtattcgtacatttctcagctatccaaggcgacggcttcaagactcttgaagaaggccaagcagttactttcgatgtagaagaaagtgaccgtggaccacaagcagttaacgtaaacaaagactaatttaaaattagaatttatcaagtcaggaatttcggttcctggctttttttatgtctttttttatttaacgctctaacttgaataaatgtttaatttctggtcgttttgttggtggggctatggcataatagactttaattaatcaacggggtgacaatggtgaaagaaaccgatttggtattagatacctgtttattggcaggaagaattatgattgaaaatggttcagaaatggctcgtgcagaagatacgattatgcggattgccacaaattcgggttatccagacgcacaggtgttttcgactgtgacaggaattatcatgtcgattccggaccaaaagaatgctcaggttgaaagtgttagtcgccgaaacattgatttagaaaaagtgagttgggttaatcgactttcaagagattatgcggttaaaaaaattacgttaactgaattcttcgatcagctaaaaattgttgatgaagctgtgccatactttccgttttggttacaggtgttgggtgctgcgctggtcagtggaccattaatgacgattttttgtaataatttttatgatattggcgttacctcaatcattggagctattgggtttgcgatttactatgcgattaataaaacattggatattaaatttatcagtgaatttgtttcatcgcttttaattgggtttatggcggtgttgacggttcgaatgggattaggtcattcggtagataacattatcattggtgctgtaatgccactggtgcctggtgtgccgttaacaaacgcggtgcgtgatattttaaacggacattttgtaagcggcccagcacggggaatagaggccttgctgacggcatctgcaattggctttggcattgcctttgtatttagattcttttaaggagaaactcactgatgattatgataattaagttgtgttttgcgtttattgccacggtcggctttggcattattattaatattccgcatcgtgcgttgcttattgccggttcaattggcaccgttacctggtttatttattgggccctgatcaacctcaattttgggattgcgctgaccaatttgttagcatctgtggcgatcggaattttgagtgacattgcggcgcgaagaatgaaaatgcccatgttgatctttaatatcccgagtttggttcccttagtgcccggcggacaagcttatcaaatggtccgtaacattgcgttaggaaacgcggctcaaggcatgcgatttttgacggaagtgattgaaattacgggttcgattgcgattggcttcctaattgctgaattattgaataaattgtggaaaaagcttcttttaaaacgcgcatcgaggggaatgtaataaaactgtaaaaatgatgatatctgattaggagtctaaaaatgttagtatgaaagtgtacatagtagttaatgggacacaggggagacattggaggaatatttttgaaggatacacaaagaaataaagttataccaggttgtttgatgacattgggtttattgcttagtctgttaatggggggcatttcggctaaggcacagtcagtaaacagctacattacagcaaacaaaattaaaccggtaggaattacgacttctatttggagtggatttccacattataattataacaagggctatgggaagcctgaaggggttgtggttcatgaaaccgctaattccagttctacaatttacaatgaaattgcatatatgaaagcacactataatgacgcttttgtccacagttttgtggatgcggatcatattattaatattgcgaataccaactacttatcttggggagttggttatcctggaaacggaaaatttgttcagtttgagcaaattgaggttcattctaagaaggcatttgcccgtgaaatggctaatgcggcgtggtatacagcatatttgctaaataaatataagctaacgccaaatgatgcttgttatgattataaagggacagtttggtcacacaaagctgttgctttacactttggtggttctacccatactgatccatacgggtactatttaaaaacgggtaaaacatacttcggtcagggatacacaatggccgagttttatcaactggtcaagagctattacacaagtctgcaacatttaagtgtgaaatatacgaataccagcttgaccatggatgttaaaacggttccgggtcatgatttctataatcatgtgcctaagagcaattacaccaccaaacgagtaaattatggcaaaacgtacgcaggaaagaccgttcaaattgattgcactggaaaacgtagtggtaccgggacactttactatcgtgcatattataacggtaaattgattggttggatttacggtggtggacttgctaaacacgtgacctacacggcaaccacaaaaacaatggatgtgaaagttacccctggccatgatttttataatcatgttaccagcagtatgtatacaaacaaacgattgcattatgggaaaacctatgcgggtaaaacagttcagattgataacatcgcgtatcgagatggcaccaaagttccttattatcgttgtgcctaccaaggcaaacggatcggctggatttacggtggagcacttggtgttcgcgtaacctacaaaacgatcaattcgaaaatgacggtcaaaaaagttcccggccacgactttttaaatcacgtcacagcaagtaagtatacggtcaaacgcctgaactatggcaaaacttacgcaggtaaagtagtgaaaattgacaatattgcttatcgtgacgacgtgaaaacaccttattaccgttgttattacggtggtaagaagattggttggatttatggaagtgcgttaagttaaaattaaaaataccttcgctgggattaaaatcctacgaaggtatttttttgtttgatttaatattgtccgttagattgcgttgtatctgaataaccagttccggttgtcacacttgttagattagatgttccagttgatttatgtccgagatctaatccttttcgaataaagtttgtaacccgttgcatttcagtttggctcgcaacctcataatcttgaccgttgattaattgcgtcgttccttgcaaatgagttgatttcaaatgatgagtagcgacacggtactttgtggaaagtgccacaatctcatcgaaagttaaatcagtttgtgtttgctttttgatggaagttaaaaagctttgactaagtaaagtggttaaagaatcactcttacgcagaattgccattaatacctgtcgttgccgtttttgacgaccataatctccttgaggatcatcatcacgcatccgcgaatagtctaatgcagctttaccggcaagtcggatctttttacctttgacaacattggcagcgccatacttaaaggtgagagtcggggtaatcgtgacacctccaacaccgttcacaattttttcaagaccgcccatgttaattaaaccatagaaatcaattgggacatctaataactgctgaattgatttaatgctggtacccgcaccgccaaatgaataagccgcatttaatttggaaggcgcgtattgtgtgtaacccggaattgaaagggcagtatcacgcggaatactcgtcagtgtcatttttttctttttaggatttagggtggcaataatgatggtatcagtccgaccacgatagttccgacctaaggcaccagtatcagttccaagaaggaggattgaaattggtttacctttttttatgactgaagaaacatcccgagccttttgaatattagcactgttgaaaacagaattagctgccttttttgcggaataccacttataggcagcaaatacgccgaggacaatgactaaaattcccacaattgcgataataaagcgtctccgtctatgttttcgtggccgtttctgtgggtcacggccttccatgtcttggtgcatctcagtgcgggtcgggggaacattaaaatggttgtgcaggtcggatcttttgggcgtttggtcctcattcatttttttgcctcctgaagcaattattaattaaagttggtgcttaacttagcataccgaattaatgttaaataaatcttatttttagattgatttaaaacattctttaaacataaaaattatatcacattaagagtgccaaaaatgactgattcgcccataaaactggttcttgattattgagtgggtttaaaaaagctccgtgatcatcaagaattaacgaatgaaaagaaatatcatttttctttaatttaaggcgtgtctttactgagtaaataggtataatggtcaatataattcacaaacacaattaaagctcgcctttgagaggaagcaatcatatggaacaacttacaaattttaaaaacgcacatcgaaaaatccaatttacaacaaaagatggtttaacgggacaactattttttgtgcagccaaacattgtgcgggtcatgattaattcgacaggaaattttaatggacaagcgacaatttcaaagaacgtggacattccgaccttaggcgatgaaacagttggcagtggaagtggtactcaagaggcgagcacaccgttattgacccaagactttttgacagcatgcggggaatcttcagaaactgggctgaacaccgacaagtttcatcttgtgttcgatcagacctctgggcatttttctattaatgacggagaatgtttccagcctcttcaggtgatagttgattgaattgttgttatgttgctatgtgttaaaaagattaatcgtcggtagcgtcatctgagtcaaagttaacgacgtgagcggaaccaacgtaattccaccatggtgctttaacagtttcggtgatgacaccgcggttttgagcatcgatcatcttaccgttgccgatgtataaaccaacgtgagaaattgatgctgcgctccaaccgaagaataccaaatcacctttttgcaggttcttgtatgataccttctggccggcgttgtattgtgcttgggcagtacgaggaagggtgacactcgcagcctttttgtaaacgtaactggtaaagcctgagcaatcaaatgctgaaggaccagtggcaccataaacatatggcttgccgaggttttgcttagcaactttataaacggctgaatatgaaacatcagtgtcggcagctttggatgcttgagcatcttggaaaccggcaaatgataatgtgaagaatgctactagcgtaagtaatatttttgtatgtaatttcattttttatcaacaactccctatcaaatctacagtgataacaataccaatgaattgttgcaaaagtgtaacaaacaatttgcaatgcagttaaatgtcatatggcagttgaaacattggtaacctggcttgtgaataaccgtttccacaagctgatttgagggtgtttataactgagcaattaaaaaagccgcccaatgtgaattgagtgacttttttgaaaaatgtcgccatgatttggattaaatttgtctgaagatgacgtggcaaaaatagaaatcttaataaattatttatttattcctcaaaagattgtctttattgggcaaggttacggccaatttccccatcgaagtgacaatcattggcaagatcaggtagtagacgcagaccgtgtaaatgacgatcaatgccgtttcaatcattgcaaacgatgcaccaaatgtgaggccaattgccaaggcaatcacgactagcagaatgtagcggacaatcttgccgtaactggccatggttggccgaatccattccagcagtgacaattccgtgtatctgaatgacaagcccaacgcaatgatctgccaggcggcaatcgcggtcaggatgctgattgcaagaattggcacctgccagtcaaattgattggtgcccgtgacataatgcatggtcagataggttaattgaaagccggtgatcgcagacattacgaatgcaacggtccaatacagcggttggagaatcgaacgactgacaacgaagacagtcaccaaaatcccgataatcactattgccaataaagtaatgaaatgatgattgagtttggactggttaatggattgtgtaatcggctcgccagtgaaggcaacctcatctgacgacagcggagttccccgcagctgcaagccaacttgagcttcgagcatcttaacctgcttaaggttggttttgctggatggggcgttgttcatgacaacttgaatggtggtaatcttcttgtcctggctggtgtagttaagcatcgtctgcaagaagtcggtgtccgccagctgcgctttggtaatgtaatagacattggccgcaccggacttttggagaccattcaaataatcatagatgttgtttaactgatcagtcgaggaattaacctgggaactgacctgttttagttgcttctggacttggctaatttgttgactgtaactctcaagattattggcgctgttttgaccgtaattttgaatgaccgatccctccgcgttcagttggctgatgcctgacgaaacactttgtaaggactgattcaattcgttaatcttctgctgatacatgcggactctgcgtgaggcgccccgctggacggcgacactggagttggcagcaacactgttaacctgtgaggctaagctggagctgtcttccacaatttgattactctttttaaccaggctctgcatgtccttgacctgttgcttgaggccggacaaattcaggttgctgccgctggtttcgatgccattggaggcctgtgaaagttgtccggttgcctgcttggcgtttaacccgatggactcaagttgattggaaacgtaatacttttcgatcggcatcccacttggctgcgttaatgaataagcggcactaacccctttggtatgctgaagtttagtggttagttggtccaaatgctgcaggtatttttcgttatccaagggctgatcgtttttaaggtaaatcgtgatcggcgtggctttaccctgtgaaaaatgtgcctggagaacgtgggcccctttaacggcttgattagtctgcgttaagttggtcattggagaaaagttcaggctggtatggtagaagtaaatgaacggtagggtcagatatagaacgaccagaaaggcggcaatcggctgccagagtgaaaaatcggttgcccggttccagaagtgggacttcatcgcactcaatggggcactggacggccagaaaatactttcccctaaagcggccaggaaaacagcgttcagggtcaagacggccagcattaagacaacgtaggtgatgccaagaacccacagtgattgtaattggtcatagttaatgaagccacagcaggcgaagatgatggccaacgcactgccgacaatggtgattggaaagcgtaggtcggcaattgtctgctgggtggcgtaacgcgcttctcgttggagtgccagcacgcttctgagtttgcggtagatgtagatgttccaaatggtgccgatcaccacggtggcaattccgatttcaagtggcgtgtattgagtgaaggcaaagtgaaaatgtttggccaatgccgttgagatactaaatgaagtcgtaaatgccgcaaataatgtaatgaaagaaatgaccggtgcaaataacgaccggaagtaaattcccacaatcagcattgaaaccacaaataatgtgatcaaaatgatgttggtaacttgcgcggttttttcattattgacgtcgcggacaatttccggactggtgacgtaggactttaatccagacacctggacttcaccaaccaattcattggtcaaaacgcgcagggtactgcttttggcatcgatatccaagctggcaatttgggtggaaccatctttagacaacaactgctgtttgccggccacgttggtgttgatggtaacgatcttcttgatactgtaaaatgattgatgggctttgagtttattcaaggcattgtcaatcttcgtctgctgcttagcggtgatcttgccgtttgggttcgtgtagaccacgttaatggtagacgcttttcccagattgtacccccaatcatttcgcagctgctgagcttgcgccggttgtgagtctttggaaaaggtgggctggctgtatgactgcagtgtatcggtcacgtttggagcggttataattgcaataaatgtaataatcagccatactaacagcgtgaataagcgatttttgtgtaattttgcgatagtttccttcattgattcgtcccctaaatatgtatgtatgaaaaaggctcatatattaagagtttaccattttataaaggctagtgcgatacgttttgggcgttttgtgttatattgggaaaattgttgtgaaatttagtcgaccatttttgatgggaggttcttaacgtgtgtacaagtatttttcaaattggccatgaagacggcgcccatgtgttgtcacggacgatggactggccgcagctgggagctcatcccgtctttgtgccccgcaactacggttggcactcggtatatgacgacaaacgttacgtcactaaatatgcgacgcttgggtccggccaccagcacgccaaacgaattgatatgtctgacggggttaatgaatttggcctggcggttcaaaaattgacctttaccaacggcagccagctagtcgaaacgccgggtgagaacaaaatccatctggcaccgtttgagctgtcgttctttttgctgtccaattatcgatcagttaaagacatcgaggaccatattgaagaaattgaactgatggctgacaagtacagcttaatgaagtatggccacagtgaattgcactttgctgcctgcgatccaaccgggcgaattgtcgtcatcgaaccggtcaccaccccaattgaaatcattgaaaatcccttgggagtcttgaccaacagcaaccatttcgatcggcaaattgacaaattaaacaagtatttggattttaccccggattttgtcaacggaaccgtccctctcaacacaccgcgggtgacgaccggcaacgtgtccggcaagtcaattccgcccggctcatattcaccaggatcgcgatttattcgggcagcatacctgaaggaaagaattgacatcccccaaaatgaaaatgaggccgtggataattgctggcacctgttggactcagtgaatgttcccaaaagtaaggagcaccagccgacttattccgtctaccgggcagccgtctgctgtgagagccgaaattactactatcagccatatcacgctaaatcagttgccaaaattcagttgacggatgacctgatcaaatcgaatgaagtaaagttttttaaagtagctgaccaaatcaccttcaatgagttaaactaatgtattgaggatatgagcggggagaaatcaagttgcgaaaacaaagttggcgggttattgtcatattattagtgacgtttgcggtgttgatcgcgggcgtttccctgcgtgggcagttaagtcaccatgcacagcgaaattccgtgccaactttggttcaaaaaaggcctgatcatttctcgactcgccaaaaacgaagctttatcaaccgcgttggcacgccggccgtcaagctgtacttgaagaatcggcaagtgttaccgagcgtcgtgatcgctcaagccattttggaatctcagtttggcacttctgaactgacaaccaccgccaataatttatttggcatcaaggggacttaccacggtcagtcggtccagttctatacccgagaggtcgagaacggtaaatcaatcaaagtcctggctcagttcagaaagtatccgaatttggcggcctcaattgccgatcacaatcaactggtcagcgagaagtttatcaaagctaaaaatattttgagttatcgaaagtcgacgcgcttgctgcaggccaatgggtacgcaaccgatcctcattatgccgccaaattaaaccgcctaattgtcaaatatcagctgagccgttatgatttaaaagcaattaatgaacgtgtatgactagcgattacattgttgaccacgtttaaatgaaaatttgttgaggtgaatgccacattgttgaattgggtttctaatttatatggtccattttttgatcctcataattgggaaacggtgattaccagcggaagtgactggctgattattctgtcgctagtcacgattgagtgtttgttgtcggtcgataatgcggtggttctcgctgcccagacacaggcgctgccgactaaagttcagcgggaaaagtccctgttctatggcttatggggcgcctacctgttccgtttcctgatcattggggtggggacttacctgattcatttttgggaaattaaggttatcggctcgctgtacctgttttatctggtttaccaatttttccgaaaaaccaagattgttcgaactaagaaactggctggcagcaaacgccacggcatttcactattctggtcggtggtcgcccaaatcgagtttatggatgtggtcttttcaatcgactcggttctggcttcgttggcgatttcgtccaacccggtgattgtcctgcttggtgggatgatcggaattctggccatgcggggcgtcgctgaagtcatcatgaagttgatggggattatccctgagcttcagccgatggcctacgtgttaattgccattattgccttgaaattattcctgtcgattccggcaattgacattgaaattccagcgacggcttttggcgggatcgtgatagcagcggttatcattactttgattattcactatgtaagaaaaaagcggaggattaacgatgagcacggaaataacgccgaataatttagcggccgaaaccaacaatccactcaccgtgatcgatttctgggcgccttggtgcggtccctgcaagattttggaccccattttggctgacttggaagctgactacggtgatcaaattcactttggcaggatgaatgtcgacggcaaccaggaaattgctgagaagtaccatgtcttaagcgttcccagcctggtcattttcaaaaatggcaaagctgctgaaaaggtgagtggcatttaccccaaagataaattaagaaaatatttcgatcaaaaaatatcagaagttcaatcaatttgacgggcagtctaccgaaatggtttgatgcccttttgttttgccatgggcgtcaacttggcatttaggatgtccaagccttgaagcggaaagttaaatatcggcgcgataatggctcgtttggcaggatcgggaaccacttggctttctttgagattgggcagcattttcgccaagtcggtttgggtgagatgaagtgccttgctgtaatacatgactcgctgaaagaccaggtttttgaaccacaggtagtagatgattccagcggcggcaatataccaaaagattgtccaagtgatgccaattttggctggggacaggatattggtgaagaaagccaagataataaaggcacaatatgttaaaatgctaattatggttagtttagattttgttgacatgattgaccaactttcataacgaaatttgtgataccatttagatataattatagacaagttggaaaaatatagatagtgagatgaaattgtgaaattttcagtagagacaattgatcgcaaagattatgcggctgtacgaggtattatcgcagatagttatcaaaatgacgggcccaacacagatggtgacgaggttgacatggttgatcgtctgcgcgacagtgaatcctatcatgatcaatttgaagtggtggccaaagatcacgatcatcgagtggttggccatgcattgatggtcccggccgaagttcgttctgcgacaggcaaatttccaattgtttccattgttgagattggtgttttacacggctatcgaaacgacgggattggtcaggaaatggtcatcgaattagaaactcgggcccgcttagccggctatcatgcggtcagcgcaatcgatcattctgatttcttctttaaaaacaactatgtgcctgctgataatttcaatatcctgccaacggtggcggttgatttcaatgataatttgatcaagccattgttcgacggggccctatatcaaaagggcggcaagatttactatcccgaagaattctttgggattcgcagcaccaactattaatttaatcattcaatgccacatgaagtagttcattcatctgagggtcagaaagccggtgggagatgcgaatcggtcaggatggattaacgaaataccgtggcggagtttaacggataataactagagccgatatcatctagtgagtgagctgtacatgtgcagctaaactgggtggtaccacgctgaagcgtcccttagtctatttttggattgagggacgctttttatatggaggagtatgtgtaatggaaaatgatgttaaagaaccaacgattagtttaaccgagggcattgtcgttctactgatgatgctattgattatgggcttcagtgtgatcaagctgcaaatttcaccgcaaattccaattttgtttgtgattctgctgttgattgcctgggctaaagttcgccgcttttcttgggactctgtcaatcagggcatcatcaacgggatttcaaccgggattattccgatgtttatttttattttgatcggggctttgattagctcatggatcgctgccggggtgattccatcactgatggtctatggttttcatttgattagtgccgagtggttcctgccatcggtctttctggtttgtacgattgttggtaccgccattgggagtgcctttacggttgtctcgaccatcgggatcgcctttcttgggatggggctcaccatgggcattaatccggccatgattgccggggcggtcatttccggggcaatctttggcgataagacctcgccgttgtcggattcaaccaacttggctgctgcggtagtgggtgctgatttattcagtcacattcgcaatctgatgtggtcaacgattccggcgttcttcacatcattgattgtcttctttttgattggccgcaccaatgcgcaactcaataccgcttcaattgaccgaacgatcaacgttttgaccgagcatttcagcatttccttgtgggcatttgttcctattgtgttgatgttcttatgtgcttggcgaaaaattccggccattccaacactgtttatcaatattttggtagcggtcgggatgctgtacgttgaggaacccaagaccaagattcaagcagtcgtcaacacgttgaccaatggctatgtgtcccatactggcaataaaaatgtcgatcaattattgactcgtggcggaattgccagcatgatggcgaccattgccttgatcatttcagccctggccctgggtggtttgttgatgaaattcggtgtgattgatgctgtgatggggccattatcacggaagctgcagtcaaatggctcgctcattttggccgttatcctcagtggcattggtgtcaatgtctttgttggggaacagtatttatcggtcattttacctgggaatgcctttaaatcaacttttgataaagcaaaattagcgccggttgccctgagtcgggctcttgaagatggcggcacggtgattaattacttgattccatggggcgtggcaggtgtttttgccgccaatacgcttcaagtttccacgatttcttacctgccatttgcgatatttagtctttcttcaccaattttttcgatcatcagcggtttcaccggcatcggtttgaaacatttgaaaatgcatgaaaacggttagcattgctactttaacaacgttttacctaaatactggtcattcttaatttaacaaacattactcactcgttacattagttacgcggagacggtttttcttaatacgcgtgatattggatggtaacttcgtaactatacactatgtattgttgatcgacgaggtcaacaaaaattctagacacagaacacagatataggagtgtgtaattttgaaaaaagtattatctatgatcttcgctacttcagccgcagctattggtttattcttcgcaggatccgcatatgcttcagcaagcacagtagttacagttaagtcaggcgacaccgtttggggaatctcacaacaatataattcctcagtaaaggctatcgagagcgcaaacaaccttcaggatgcaaacgtcattcaagttggtcagcaattaacaattccttcagctgacaccgcatcaaatactcaaggtagtgcacatgcagcaaccgcaacgactcaacagactcagagttacagccaaccagctcaaactcaaaccaaccaagcacagactagccaagcatcaacttcaactagcactgctaccagcggttcagttgctgaacaagcagctcaattgatggaacaaaagactggtgtttcagcatcaacttggatggccatcagttaccgtgaatcaagaaacaacccaacagcacaaaacccaagctcaactgctcacggtttgtaccaatcactttacacaacaagtaatgactggcgcgaacaagtaaacgacgcagcacggatttaccattcacaaggaatgggtgcttgggcattaaattaagagcgtgaagagccccgggttgatcccggagcacaagggaaggcggccaatgatgaacttgttcatcgttggtcgtcttttcttgtgcagtagggatcagggggtcggagcgcattttccactaggtagcagtggtgctgtcggagcgcattttccactaggtagcagtggtgctgtcggagcgtattttaaccaggtggcagcggtacaaggtcaaagatgccaattaccaaataaaaaatatccgcctcactgcggatatctttcctacataaaaattcaattatccccgtaccaacaactcgatttgacctttttgaggcgcgaaattaattccgacaagtggttcgcgcaaaatctttccatactcatccaaaacatcggatggcagtggggtgtgggccttgagggacgcaaccacatcaccggcatcgtgagcttcagataagtcgatgaataaattgactttgttgaccacgtcacggaacaggtcggttaaaatcccgttaggtttcccctcaacatcggtgataacgacctgcgaagaatcgaatgctaaatggttaaagcgcaccatttgtaaaacgtcaaacaggttatccattgacaacaagtcccttcatgatgattcatttaatattaagtgtagccgtttgcatattcaaaaggcaagtattatatcgttctgttgataaattcgatctaaaaaggtgccgtgacgcagccattcagctgtatcacggcaccttattaccatctaaacggtgttagtcaccattcatgattgaatttttaacgatcacgtaatcaactttggtaatatcattcaacttgcggccaccggcatatgaaatcgacgactgcagatcttgttgcatttcgttcaaagtatctgagatgtgaccacggtaaggaaccaacatttgtcggccttcaacgttgcggtaggcacccttttgacgctcggatgctgacccccagtattgcttgtatttcttgccatcaatactgatcaggttaccaggagtttcttcatgaccggcaaataatgaaccgatcatcaccattgaagcaccaaaccgcacagacttggcgatatcgccattgtaacgaataccaccgtcggcgatcattggcttccgagctgctttggagcacaaacgcagtgcagctaactgccagccgccggtaccaaacccggtcttgagcttggtgatacatgctttaccaggtcccacaccaattttggtagcgtcagcgccggcattttcaatttcgcggacagcttcaggtgttcccaagtttccggcaatcaagaaactgtctggtaattgttccttgatgtaatgaatcatctggataacatagtctgaatgaccatgagcaacgtcaatcgtgatatattcaggcttctcgttgtcggcaaccaacttgtcgatgaattcatattcttctggcttgattccaacactgatagaagcataaagatcctttgaatgcatcattttgatgaaaccttcacgcttttcaggttgaaatctatgcatgatgtagaagtaaccgttttgtgccagccaaacggccaggtcatcatcgataacggtttccatattggcaggaacaacggggatcttaaatgtcttaggtccgaattttactgaagtgtcagcttcactccgactcttaataatgttcttgttagggatgagttgaatatcttcgtaatcaaatacttccatgatttacctccgaggttttaggacagctccgtcaggtagacagtttataagcgcctgactcttcttgcgactttaggacagctccgcaaagcagaagtctgcgcctaagcacctctaacaaaattccaagacccggaattctgttagaggagacttaggcactgacttctaagcgctttgctccgctcactgttttaggacagctcctccaagcagaagtctgcacctaagcacctctaacaaaattccaaggcccggaattccgttagaggaacttaggctccgacttctaaccgcttggatccgctcactgttttttaccaaactttttccacgacgttcgtctgttctctgtcaggaccgactgagaaggttgcgtaagggactccgactgctttttggacatggtttaaataattttgagcgttggttggtagttcatcaaatgtcttgcacttggtaatgtcttcgtcccatcccggcaattcgtcgtaaacaggcttgcaggcatcgagttcttttaaggttgcgggataatggtcaatcttcttgccgtttaattcataagcaacgcagattttcaaagttttaataccggttaggatatccaaacagttcagtgccaaatgggtgtagccgctgacacgcgccgagtggcgtaaaaccacactgtcgaaccagccgattcggcgtgggcgcttggttacaacgccatattcatggccgacttcccggatatgatcaccgatttcatcgtggagttcggttgggaagggaccctcgccgacacgtgaagtataggctttgcagacaccgatcacgtggtcgatccgattagggccaaccccggttccaacggcggcaccaccagcacttgggttcgatgaagtgacaaacggataagttccgtggtcaacatcaagcatgaccccttgagcgccttcaaataaaacatttttgtgatcgtccagcgcgttgttaataatataggaagcatcaacaacgtatgggcggatgcgatcggcgtattcgttatattcattgaagatcggttcaaattctaatggttcatggtcatagattttagtgagtaattcgttcttaacttgtagattgcttcgaagcttttcttcaaagatatccttatcaagtaaatcggcaattcggatgccaattctctcgtatttgtccatgtaagcagggccaattcctttgttggttgtcccaatcttagaatccttcttttgctcctggagaccatcgaagagaatgtggtatggcatgataacttgagcacggttggaaattctcaaattatcagtactgattccatcctttttcaaattgtccatttcgttgatcagggatttggggttaacgacaacaccgttaccaattacactgtacttttcctgatcaaaaatacctgatggaatcagttgtaaatgatagctgttgccgttaaatacaatggtgtggccggcattgtcgccgccttgatagcgggcaataatatcagccctttggccgaagaaatcggtaatcttacctttcccttcgtcgccccattgacttccaacaatcacaatagatgacatatgaacacctctaaattttattgccaggaatctacccagcatttttaataataccaacttgtattccattaatcaaccaaaaggttaataatttttacaagtaaaacgtttaatattcgactttgaaaccgaatacgaacgaaaggtaattattattctcataatatagtcaaaaagtgaacaatatggtattattatcctgtcattatttagtagaaaggactcgttatgatagatagatattctttacctgaaatgagcaacatttggtcactgcaaaaccaatacgcttcatggctcaaagttgaaattgccattgatgaagcatggtccaagctggggaagatccccgctgaggacgttgagaagattaagaagaacgccaagtttgacgttgatggcatcgccgaaatcgaggcggtgacccatcacgatatcgtggcatttacccgcgacgtctccaaatcacttggcccagagaaaaaatggatccattatggggttaccagtaccgatgtcgttgatactgcctggggtgttcgaatcaagcaggccaacgaaattattcgaaaagatattgatgcatttattgatgtgattgccaaacaagctaaaaaatacaaggatactgtcatgattggccgaacccacggtgttcaagctgaaccaaccacctttgggttaaagctggcgcgttggtattctgaaatgaaccgtaacaagcgtcggtttgcgactgcttctaaggaactggaggctggccaaatttccggtgctgtgggaacctttgccaatgtgccgccgtttgttgaacagtacgtgtgtgactcacttggtttacgtgcccaggaaattaccagtcaaattctcccgcgtgatctgcacgccgattatatttcaaccttggcactgattgccaccagcttggaagaatttgccactgaaattcgtggactgcagcgttccgagattcatgaagttgaagaacatttcgatgccggccaaaagggctcttctgcgatgccgcataagaagaatccaattggatccgaaaatatttgtggcttggcacgggttgttcgcggccacatggtaactgcttatgaagatgttgccttatggcatgaacgagatatctcacattcatcagctgaacggatcattattcctgacaccttgacactgttggattacatgctgcaccgcttcaccaggatcctggatcgactaaccgttttcccagaacggatgaagagcaacatgggcctgacctacggcttgatttacagccagcgggtgatgttgaagttaatcgatgccggaatgactcgtgaacaggcatacgacttggttcaaccattgactaaacaatcatgggataagggcattcagttccgtgacttggttgaaggcgataagaagatcactgatgctttgagtgaagatcaaatcaacgatgcttttgattaccattaccacattcgccatgttggtgaaatctttgcccgagttggcttggaataaccaacggacggtgaattttaaattgaattaacctgaaatcgattagtactaactgacgagggattggacaagacgatctgttttgtccaagccctcgtttagttttttcgcttttacctagcggaattgtgaaaaaataagcagcttccggccatacaagggggattaacccaatgtccaaatcctggatattgggttaatcccccttgtactctggaagctaagcgcttattttttcacactgacatttatggcagaaataccaatcgattatcgccataatcattccatttttcagcaatctggctgagtgggaaggtagtcaacggtactgcaatcttgccatcggtaatcatcttcaataaagccggcatatcatccgccaagttggctgcggtgaacgagccgaagccactgccgattaaatggaagtcaatacttcgaaacaagctgcctttcagcggtgagctctggccggccatggagccgatttgaacccaggttaaagtgtgttgcggatcttggcgctgggcaatcatatcggtaatcatagttgccgcaatgtcgccccataaatagtccaaaaccacgtcgacgtcgccaatcttggccaagtcagcttttagttgatcatcgttatcagttaatttgatggttgaggtgacaccaaattggctcaattttgctagtttttctggattgcggccgacgccgattacttcggtcgcaccaaaactaatgctgatggggatagcaagttggcctgaagcgccggttgcgcccagcactaagactcgcttgccgcggatcttgtcttcgcccaagcgttccttgatcgccataaacgacgacattgccgggttagctgtagcggcgacaaccgccggatcagcggtattatcgattgggaacagtgcccgtcggttgacgactgctttttcggccaaagtcccataaacgttattgctgctgttgaagtagacgtgttcaccgtcggccgtttcaccaacggcatctacgccggggacgatcggtagggtgctggctgcggaatagtgagtgccgtttgccctggcgcgggcgagttggctgactgcggccgccaagatgtggacctcaacttcaccatcttcgactttgggattggggaaatcgccgtactccggaccacgggtaaaatcattaataattgctgctttcatgtgaatgttccttaattgtcatttaaatggaatcattgaaagtgtgctttcaatatggcctttatgatgattgatgacggttggttttgcaacgatattgacttttgaattggtgggatgtcgatttggcagacgttcgagttatcaaaacgcctctcgttccactctcaactatatttcgccatggcggccagtatccaaaaagcgcaccgtgtcgccgacaatttcataaattaataaccaactgcccttgatgaacaaggctcgttgaggctttctgctcttaatgacgtgatcatcatacttttcagcgactggttgaccactcaaaatctgctcttctactgttctgaaatcagcctcagtgtatcggttggcacgaatcatgttttgataatgtttcttgaatctggactggtacttgggttgatatttgcgcattaattgactccctctcgaatgatgatagctttcattatagcttttttgactggatctgaggacagaaaaaaggcccggcgggggagccggacctttcagttcaatattctgaggggaatatgaatatgataatctggacaacaaatcaatggggggattgatttgctgctcaatgttattggggggtgagtagaaataaatctcgtttatctcttgctcatggttataatatacatgataaatataaaaaaagttggacgaaagtgtgaactttttgtgaattttagcaaacttattttggcggataaaaaaggctgcggcgaaagattgtgaccttcgcgacagtccattttatacctaatctttttttgagggggagataaggtttaaatcaaattgattttatcatttctgacaaatatgaggtgaagagaagccttaacttctattcaaaataagcatacaggaaaagttaggctaaagtatgaattaattgtgaagattttgtgaactttttcaatcgattggatagtgggcacaaaaaaagataagacacggggatgccttacctcaagttacctatattctaggggaagaatatgaatacaaaagtaataaattaaagggggatttaatttattgccacataaaatgacgtatcactttatgtttatatctacactatatagaatgaatatgaccaaagtttgaaaaaagtgtgaagattttgtgaacttttgcgaatttcaccacaatttgtccgataaatttataaaagattaaaattgaccgtaagaaacagcgagatgaggaggatttcaaatgagctttatggctaaacggtttatcaagaaatttagggctgaaaactacaaaaaaagcgtcgcccacagcttcttgaagcctaatcagaagatcaatatttttcgtcaaagtgctgatcagtacaaaattcgtccggtcaaaaatggccagttggtcacaattcaaccaattcaaaaccccaccagccagattctctatttccatggtggggcatttacagtgccgatgaatgaagaccaactggaaatgattaccaagattgccacagaatcaaatagtctgatccaagtggctgattttccactgttgcctaaacacagggcagacgaaatcttacaatttacccaggcagcatttgacttggtgattgagtcggaactgccgacattcattgttgccgattcggctggggcaaagattgctttgcagctgctggtggataatccaggaaaagcagctggcagcagtttcatctcgccgtggttggacaccaagttgaccagcccagcgattgccgagcgggctgatgaggacatcttattggatctaccaacattgcaggagattggccgttggtttgaccaaggggccacgcctgaaaaatgggtcgattataccgatgcggatcgattaaaaggagtcggcccagttcaaatcttctatggtgaaaatgagatgctggttccctgcgatcttcagttcattgaggcattacagaatgccgagggagccgatccagaagtcattgcctttaaggatgggtatcatgactacaccctttggttcaaattgtccgaaacaaaaaagacctttagacgaattgctgaattcattaaagatcaacgtggtgcttaagcttggggaaggcatgggtgtcggaccatttcatcattgtgccttggaacagtaaggcaaagatggttccaaaaccaattgcataaagtttcccggtaaataaataggatgccgagatgatgacgaccggtggaatgtagctcagccactgggataacacggcactgccatgaatgtatttgaaacggatgatgtatgccaagtcgtcgttgggatgcataatcaagttggcccgggcgtacatcgaaactgccattgccacgcaatacaggccgatgatatccaaaatgaggcggacgtagaagtccattgccgggactcctagtgaattaaagatgaatgtgaacagcgctaccaggtaactgaacggcacggtgtaaagcaggttggagaaaaaccggcggcggtcaaaggaccccagtagtaactgattgctcaaagtaacaatgatgccgtagataaacagcgtcgttcccagggggatgttgacccatttggaaaggttaacagcggatccggtccacaccgcgcttccgaggttggaggaaattgccagggcgtttcccgcagagttaataataattgacagccccaggtaataaaggcgctgcttgaagtctttcatttttgccattatgtattcaaattctccttcaattgatcatgaattccattgtataatatttaatttggtttgaacatctttactgaaagcctcctggtcaaattgatactgttctttcacaaatcgtgttaatattcacggtagaggaggcggtcttgtggaacgagaatattcggaagtagaagctgagaagcatttcgaaaataatcgtctgtggtttcggcgattccaaacaacccgctcatttcgaaagttaaccaaacccgaaagagcagcagctggatacattactcaggcatttgttggcttagcatataaatatcaattacgaagtccgcgacaatattctgcaaagtcggtcaaagaagttgtcatggatttatttccggaaaaaattgcagcgaccaacgtctttttcacatccgttatcccagtgatgcatcgctactttgtcttcctgggtgtgcagcacaaaattagcaacgcaaaaacgctgatcaaagcgttggaaagcatcaaggtgcgtcagctgttggatggccatcggaatgccagcaactgggatgcccacaagaaactgggcatgcaggtgctgatgggctataagcaggatgtggatcccaagaaggtctcggcgtacgaagaagattataatatgggcgtcccgctgaggttctgtttcgacttcagcgtcaatcggccgccaaagaatattattttgctgacagagaagttaagaaagaaattcgaaaatgtgatgtatgagaacaacaagtagagcgcgacgagccccgggtgaccccggagcacaagtcaaaaggaccagtgatgaacggttttcgttcatcactggtccttttgacttgtgtagcaggggtcaggggcgtcggagcgtattttggaagcagcagggagcggtagataaaataagtgctcaaatccttgtaatatcaacaccatggaactgggggggtgctgaacgggttctgttcatcttggggatttcttgtttatgcagtagggtcctggggcgtcgcccacaggactaggcaggctttcagccggccgtcggagcgtatttttaatgctggtaggcgcagatgataaacgagtggattcagttcgtgaatttcggcttaaccaaacaaactcagcttgccgataaacccacatcgttttatcctgaaattaatatcagttttaggagatgaacagaatcaaaaaaatattaatcataatcacatcactcgtcctactggtaggctcgtacttcttatggacaatggtcactttcgatgagcatgctgaaagctacatccaaagagatctcaacaagaatatccgcgaccatcaataccacaagctaaggaaaatgagtaactcggccgcctatgaatggttgagaaaagcaaatcacgtgaaatttacttttagttcggataatcaaggaagtggcaacttatattattatgctgcaaggatcaatcaccaatacaatttttttgtctcctttaaggtgaaatcatttattccaagtcggttcactttgactcggatcacctattaccctaactatcatccgcgctgattcaattcatcaaacaaaaaaagacctccgcagccaaccagccacgaagcgcccacaaataatattcagcaaacaacaactaatttaaaacctgaacgcgatcaatgctccccaacttgaccaccgtgacgcctttagcaggacgctcgatgaaagcctgatcgtcattgactgcagcgacacttcctgtcagcgtgccgtcgccggtttgaatgcgcactaattttttattcttataagcattcatcaattcatttgaaatttcttttgtcgcaatagtcaacattgtcacctcttatgataaaattaattatagttcacaattctgctggatgtaaacaatttttctcacaagcataagcttaagaataatttattaacatttttttgcatttagcgctaaagtggatatataggtaagtgaaaggggtattgaaatgactgaacgccaaatgattcaagaaattttaaataccgttgatgttatttatagttttgtcaacaccgacgatgacaagaaggaatacgaaattgtgatcaaccgccaagacggagataatcgtccgcttgagaacgtcaacaaggaaatcaaacattacttcactgatgccaactttagttatgatgaagagcttaatgacaatggcgacgacattcacgtgcaggtaaaacgttaattggtctagttgagtattacttcacaaaaagtgattgaaccagcaatttgaattgtaatgcacgttatggtatagttcataatgtgcttttttaatataatcaaaaggctataaattgatttgaaaattcgagttaccgaaaaatttttaatggaatatgtaatcgctttctagtgtttggagggaatctaatgttaacagacagaccaaaatatgttttatcaattgatcaaggtacgacttcgactcgagcaatgatttttgaccacagcggtcggaaagttattgaagcttcaaagcccgttaagcaggcaatcccacataatggctgggttgaaacagaccccaatgagatttggacatccgttttgaatgtgatttcttcggcgttcattgatgccggcattcatccagaagatattgagggaatcggcatcgttaaccaacgtgaaaccacccttatttgggacaaggagaccggtgaaccaatttataatgcaattggttggcagtctaagcaaaccgccgctttggcccgaaaattaaagaatgacggctattctggtatgattcacaagaagaccggcttgattattgactcttatttctcagcaaccaaggtccgctggattttggaccacattgatggtgctcaagagcgtgccgaaaaaggtgagttgatgtttggaacggttgatacgtggctggtttggaaactttccggtggcgagtatcacgttaccgattactcaaacgccagtcgtaccatgctgtttaacattcacaccctgcaatgggatgatgatattttaaaattactcaacattccaaaggccatgctgccagaagtgaagacttccagtgaactatatgggacgacgaagaattatcaattctatggtattgaagtgccaatcgccgggattgccggtgaccagtcggccgctttgattgggcagctggcgtttgaaccgggcatgattaaaaatacttatggtgatggtgccttcattatgatgaataccggctccaaaccagagatttcagatgataacctgctgacgacgattgcttataatttcaacgggaaagtcacctatgcgcttgaaggttcaatttttgctgccggaactgctttgtcctggttggcagacagcctgcaactcattgacaacgttcctgaatcccgtcaggcggctatgaattccgaagacgacgatgaagtctatgttgtcccagcattcaacggtttaggagccccctactgggaacaagatgttcgtggggcggtcttcggcttaactcgcggaacgaccaaggacgactttgtgaaggcaaccttgcagtcgatcgcatacggtaccaaggacatcattcagaccatggaaaaagataccagcatgcacatccctgaactgatggctgacggtggcgcttcacggaacagttacctgatgcagttccaagctgatattttaaatatcccaatccaacgggcggctgatgagaacaccactgcatttggtgccgccatcttggctggactggcagtcggtttctggaaggatattgatgaaatcaagagcctccaagagccgggccgaactttcacaccaaacatggaagattcacgccgacaaaagctgtatcgcggctggcaggctgctgtgcaggctactcggggatatcgggttaaaatttaggcttacagtttaatagtgtacaaaaatagagtgctcagtcaaaaattgatttttggctgagcactctatttatattattcatttttatcttttggctctttccaataattagcattactgagcagttccttagaccgtttatccgcgggaacaaagccaatgttgaacaggtgcttgaagtacatcatgttataaatcagcatccaaacgatgccgagaccatatgagccaagggtgtaggcaacttggaatggttcgcccattccaagtgacagcgccattccggcaatgatttccactccagccatacacagcaggttataccagtctgatcggaaaattggcacccagaggttgaataaaagggcggtgaatgacggaccaactttggcgatccgaatctgaccgttttctttgttcacgacagtagcaaagttcggtggaatcgggagtccagttggattgttaggatcattttggttattgtcatcattattgccattaccaaatgggttttgcatggggagcctcctttcgaactaatggttactttttcttgaatttaacaacacattcacaacgggaggtttgcggcatcaaatccactgattgaatatattcaacgttatacttctcggttaattttactaaatcctgcgccaaagtcgatgggttacaggaaatgtagacgaatttcttcggcacgatatctaaaatggtgtcaatcagcgaatccgctaaaccagttcgtgggggatcgacgattaatgcggtcggagtccagccgtcgtcaacccactccggaagcagttcctcagcttcaccgacctcgtataaacagttaaagatgccgttacgcactgaattggcattggcgtcttgaaccgcttcggcaatcgtatccatcccgcggacttcgcggacctgcttggccaccgaaaggccgatggtcccgacacctgaataggcatcaaccaatttttcgttgcccttgagatccagtgctttgaaggcctcatcataaaggatcgaggtcattgcagggttggcctggagaaatgcccgggcggataaatcaaacttcaggccgttaagcacttctgtgatggtttcccgaccagccagatgaatcatttcatcgccccaaatcagtgaggttctgcccggattaacattttgcatgactgaaacgacttccggtaattccgccttgatgcgttccaatagctggtgcttcttgagcagtttcttgctttgagtgataaaggtgacctggacttgatcggttgcgatggcggctcggacaacgacggttttgatgatcccggcgtttttctcttcgtcatatgcggggatgcccagttcatcaatcatcgtcacaattgcccgcatgactttcatcgtcagtgggtactgtaatgctgaggtcttgaggtcaacaacgtcatggctgcgggctttgtacaagccggcaatcgtgttgccgttctcgtcgtgacggatttggaatgtcgccttgttccggtaatgggtcggatcatccataccgatggttggcagcagcttaaagcggcgataaccggtgggctggtatttttccagcgactggcggacaacgtctcgtttgaactccaattgctttgggtaggccaaattttccaactcaaaaccgccaacgtcatttgcgtagtcgtccactggttgaatccggtccttgctcttgatcaaaatttcgacgagcttggcccggataaagttatttaaatcgttggtgacttcaacgatgactttttcggttgggagcgcaccgggaacgaaaaccagtttgcgttcgtagtaaccgatgccttcgccgttgattcccattcgcttaatttcaatggttaattgttcaccttcgttaacgtgaaccgtattattatcgttatacattgaaccgtccttaatattcttagttactagtatgatagcacatcacgagggctattcgcatgtgaagcaggcggacgcgaggtgtttcgtcaaagaatttaaggcaatcaatcgattatccttaattgcggacaaaagattgattgccttaaatggctggcggccacggttaccgcggattgagggtaacaaaagtggcgcaccaaatgaattgagctttttctaaaataaattctggattgaattgaatcaatcgacttaccaggttgcagtatcaggatcggttgccaaacctgcttgaccatggaagccgtcaatggtcttcatatcggtatttgacaagttaaagtcgaagatatcggcattttctttaatgtacttctcgtggattgattttggcagcggcaggaatccatgctgcagtgaccagcggagaaccacctgagccggcgtcttgtcatactttcgaccaattgtagccaattctggaatcttgaaaatttcaccggttccaagaggactgtaagcttcggtcaaaatatcgtggtcatcattatattccacgaccgccggctgcatgtccgacggattgatgaacatctggttaaccattggcttaaccttagccgtttccaacaatgcgtccaaatgttttggccggaagttggaaacaccaattgccttggcagtcccggctgcataaaattcttccatggcccgccaggattcagcgttggcttcctgccaattgtctcgaaaggcaaccggattgggccaatgaatcaagtagagattgacatagtccaatcccaacttttccaaggatcggccaaaggcttccttggtcttctcataaccgtgatcagcattccagagtttggttgtcacaaataaatcttcccggggaacgccgctatctttgatggcttgaccgacactttcctcgttgccgtaagctgcagctgtgtcaatgtggcgatagccggcgttaagagctgctaaaacggcatggtaagcctcatcgccattggcggattgccaagtaccaaagccgacttggggaatcttgaccccgttatataaggtgtacgtatctgttaatgacatgttcgaacctcctattgtgtctctaacactattttatagaaatcaaatatgaagtacaaagaatttatccattgaggagtgctcaccgttattcaggggatgccccaaatcggtaaagccgtattcagtgtacaggtgaattgcttctttcaaagcgtggtgggtctccaggtagaccgtctgatagccggcccccttggcaaacccgaccgctgtgtccaacaatctgtagctgagatggtggccgcgggccgagtcagttaaatacagtttctgaagttcggccacatgattggcatgatcgaactcagcgatgccgttgccacccaggacgttgccggcgtcatcgacagcaacgaagtattcccggtcatccttttggccatagaagctgctcaaatggtcaagttctttgtcgaaatacgcggtccccggaatatccagtccgtatgattttaaaatggtccgaataatttttgccagctcgaagtcatcttgttgtttaatcggccgtatttttaccattctatcagctcctgtccttaacgtttgattagcatattaccacttttggaattgcagagtaaagcccatgtgaacgctttatcgtgatatactggaactaatttggaacaagttcgggagggatcactatggatcaaagagttgcgattgtgacgggcgcttcatcaggaatcggcatgcagattgccaagaacctctatcgaaacggtatggaagtctatgcactggctcgcagagtgtatgcgatgaacgagctggatgatttgggtatccacaccatgcatttggatgttaccgaccacgatgaaatcgatcgggtcgtcagtgagatcgtcgccaaaaccggccggattgatgtcttagtcaataacgccggcatcggatcgtttggctcggttgaagaagtcaccttgacggaaggcgagtacgaattcaaagtcaacgtcttcggtttagtcaaaatgattcaagcggtcctgccgatcatgcgaaagcagcatagcggccggattatcaacatgtcatccatggccggcaagattggcaacatgctcttgggcagctggtacatcggctccaaattcgcagtggaggggatcagtgattcgctgcgacaggaattgaaaccatttggcattgacgtggcaatcatcgaacccggtgcgattcagtccgagtggaaggatggtgccatggaccggatgatggatgcgtctggcagcggtccctatgccaaattggcccggcgatcggcggctttctttgcgatttcctacaagtttgctgcagccccgagggtagtggccagatctgtcgaccgggcagtcttttccagacgaccgaagaccaggtatgcgattggaacgggcgctaaaccggcaatgttaatgaagcgcttcatgccggacaagtgcctggacgccttctttgaggccttgaataagtacgctcagcaagttgtcaaccgagaaacgggtcaaaacagatagcaattgaccactgaaattaaataaagtaccattaacttagaaacactgggggaactgctatgtagcagctgagaccgacctgaaccaggtcgaaaccctttgaacctgtcagctaggactggggtagggaagcagagtgcgatcacgggcggttagtgaccggagtctaagggactttggacggaaatcgagttagattttcggccgaagttccttagatgcaggccactgcccctgggagcacgtttccgctagataacagcaaaaatccagcagagtgcgacgagacccgggttgaccccggagtgtaaggcgggaatttaaaggatgaacgggtttggttcatcgtttaaatttttgccttacacggtaggggtcagggccttggagcacgtttccgctagataacagcaaaaatccagcagaaaccaccaaccaaaaccaatcacccaggagctgcagacaccaagtgtctcagctcctatttttgtcagcaagcaaaacaacaaaggagaaggatcaaatgaaaatcgatttattagacacattacgaaaaaagaaccccatcgcttttaacatctccaactttgttaccgttcaagatgttgccaatggcattaatgcgttgggtgcatcaccaattatgtctgaagaaaagaacgaggccgagccaatggtccaaatggccgactcggtgaccgttaacctgggcgcgtttaccgagggtcagttggaacagattagtgcggtaacgactttcgccaatcaatacaagaaacccatcatcatcgacccagtggctgtgggcgcggttgactaccgtaaagaacgctgcaatgaattactggatcagattgatgtcgcggtcattcgtggtaacgcgggtgagattgctgcattggcggacgttgagtggaatgccaaggggattgatgccggtgaaggcagcggtgacttggaagaaattgccaagaaattagccaagaagcgcaactgtgtcgtggttgaaagcggcaagaccgatatcattaccgatggtgaggcggtggtccgaatctacaatgaaacggatttgttcaagctgcacgttggttccggggatatgctgtccagtaccatcggttgcttctgtggtgtcgagcacgactatttcgaagcagcccagacggccacgtcggtctttgatgtggccggtgaagtcgttgccaaatcaatgcccaaaccgctggcaggatcatttggtgttcagttgatcgacgagcttcatttgattgatactaagaccgttgagaagtatgcgaattttgagtagaaaagagtgcgacgaggcccggtttgaccccggagtgtaaggcggaaatttaaaggatgaacggttttggttcatcgtttgaatttttgccttacacagtagggggtcagggccgttggagaacgtttccacaaagtatgatatatacggaaaaacccacatgatcacaagctcaacaaagaaaggtaggactcaaaataatggttaacgaaacagttcaaactttaacaatcgcgggaactgacagtggtggcggtgccggcgtgatggccgacattaagaccatgcagatgcgccacgttttctcggcggcagtgattgtggccgtcacggcgcaaaacacgattggggttcaggactttatgccgattcccaagaaactgattgatgaacagtttgcctcagtcgcagacgatttgaaaattcgcgcttgtaaaacagggatgttggcggacgtcgccacggttgaagcagtggttgagaatttgaaaaaatatgatttggggactctcacggttgatccggtgatggttgccaaaggtggtgcccgcttgctttcagaagatgcgattaagacggttcgtgagcagttgttgccgctggccgatattttgacacccaatttgcctgaggccgaagaattgactggcatgaagattgaagacaaggatcagatgatcgatgccgccaagaagctgcaggatctgggggttaaaaacgttttgatcaagggcggccaccaaactgaatcaaaagagtcctcagacttcattctccttgagagcggcaaatccttctgggtgagctcaccgcgaattgacacggttcgaactcacgggactggcgacacgctctcgtcttgcattaccgcagagattgccaagggcgccgatgttgaaacggccatccggattggtaagaagtacgttcaagcaaccattgccaatgggattcaagtcggtcatgggcatgggccactgaaccactgggccacatttgaaggggacggtgactaagatgggcatgcaatttgaaccggggatgctgcgagcttactttattgccggcacccaagatgtgaaggatcaaaccaagacgctgcaagaaattgccaaacaagcgatggaggccggcatcaccgcctttcaatatcgtgagaagggacccggctccttatccggtgccaagcgggacgaaatggccgccgacttgcgggaaatgtgcagtgattatgagattccatttatcgtcgatgatgacgttgacttggcagttaaaaccaacgcggacggcgttcacgtcggccaaaaggatgagcgggtcaccaaagtcatcgaagcagtcggccagtcgatgtttgtcggcttgtcctgtgacaccaaagagcaggttaacatcgccaatcacattgacggtatcagctatcttggcagcggcccggtctttccaaccgggtctaaagccgacgccgatccggtgattggcgtcgatgggctggcaactttggttaaggcgagccaactgccagtggtcgcaattggcggcattaccgagcaaaatattgtcgagcttccccaaaccggggtcgccggtgtttcggtgatttccatgattgcccaaagtgatgatatctttagaacggttaaagtaatgaacgaaacctttgaaaagtaagggcttcgcaatcagttgaaatagacaattaagcggatagcgcactcctgtgattttccaggattgtgctatccgcttacgtgctgctattgagtgatgttggccaattattccatgttaaagccctcaacggttgcgtggggcaggtggttaacttcgccggtcatggtcttcatgacgtcggtattgttgcgggtgtaatacgagacttgataagggccgggcccgtttaccttacccttgtaggtttctagaaccggttgaacaaaaccggccacatctttgttggtgacccgggccaaattaacgtcgctggtgttgggtgttccaaacgctttccagtcagtcgtcgaagtcggtccgaagacgaagtagctgccggagcggtcataagaagtctcgtcagaatgaattttgacactgtgctttccaaaataaatgttagattggttgccataccaggcaccgcgaaatggttgggccacttcgcttggatttgaagccgaggcatcttctcgatgatgggagacgacaccggaaagcccgatggtgcctacaaaaatcagcgttaagataatcgtgattgtcgattttttcatgataaacgctccccaaatatgcttatctattaccatctaaagggtactccggcaatgtaaattaagtgtaaacattgggtatcaaatatgtacaaaattgatattactcgaagattacctccaagttacaattattaggtttggataaaatccatgcataaaacttgtgattttggcggaaagccgttttaatagaacatgaacacgtttttattttcaaaatatttaattggggtgagattgaatgaaaggacattttaagttagcccttacggctgcgttcctgttcgtgtccgccggcatttttggtgtcgctgcaccaactgccagcgccgacgtgattgccaatcctgggactgcgggttcgattccgcaggtcaatgcagggaacgtattgaaggactacgatgagaattcactcaacgtggttaacaactcaacaccgcagggtaacacaagcaagaagtataccaagtattcattggatccaactggttacaactacggcaactcgtacaatacaattgccggcagttcacaaagcaatacatttaagacgaagttcttcttaccagatggcttcaatgtttccaactatcaacatggtaacttccaaagtgtcacacttgatggcgatgggaacatttacttcatcgaatcaaatggtaccaacaccaaccagggggcaattgttaagttcaacatggctaagcttcaacagttaggcgttggatcggatgttttactgctgtggcgggcatttgattacttcaacccgtatacgacagacggtcaagctcataacgatgagtacaaccaggtcaacgcgcaattacaaggtgcatttgacaaggttcagaccttgacgacgactttgaatcagaataagtcctggcaaaataaccagaacaactggaagaagaacgctcaaaagtggtattactactggaagaacaagaaagccaagtataccaagatttccaagtcatataagtattcatacaatacccgggccaaggctaagaagactgtgaagacagctacttcaaagatggcaacttggatgaaatcttatcagtcacacaaggctaagattgccaagtacaataccaagatcaatagtattcaatctcaaatcgatacttatcaaggacaaattgacgacgccaaggcgcaaaaccctgacatgttcaaatacgttgatattgcccagacagcacagttgtctccagaagttgatattggccatggtcaaacattgtcatacaacccacaaaacaagcacatctatttagctgaagataacacgttgactgatttggcatcacgggatgataacaacacggttcttgaaatggatccgaataccttgaaaccaatccgtgaatacaacttcaagatgtatcatggcgactctgccaacttgcagcttcacacactggcatttgacagtaaaggaaatgcttattggggccgtaagttgaacggtggttacatgttcttctacggacggcttgatgaaaatggtgtcagcttccaggcttcatcatcaatggtcggcaagcgtggcggttccacgaaccaaggagttgccgttaaccctgccaataaccgtttgtacttcgtttctgatgatatcttgacctcagtgccaacatcaggcgttcaaagcggaaacttctcggcagacgatatccactatcaagccttcgattccggtcgtgagtttgaaagcttagcgtttgaccaagacggttacggatacttgctggcattgtggccacctgagttgatgcaatcgactaatcctttgaattaattaaataggtgagagcaggaatttcctgtttgatgtttatgagtagcagtcgcgagtttgcggctgctattttttgttggggcaaaatcgtcatctcaaaggtgacattaccaggcagtaggcctaatttgtcaaaacaattaaatagtccgccaatcaaaaaagagaccgagacataactattgtgaggttacgtctcggcctctcttgggctccaatgatatctagtttaaacgtgcaacaatcggctgatcccggccatttaagcggagaaacaagtcattccaaaaacaggaataactcgcttctccgcttaaattctgggatcaaaacgcctcgtgccgcactctcttttattaccctgcatatgcctgagccaaaccggcaatgtctgccgaagtgatgtcgttgtcggcaaccgttggatacatgatgctgtctgtatcgtcagaatgctgcaatcccaatgcatggccgagttcgtgctcgccgacgtggattctttctgtcgtcgtgtatttgaagagactacagttattggcgtaaatcgttgaagtggatggcgccaacaagaacaaattgttcttctgtttctgataatacttgacggtcgtcatcccagcatagtctaaattatccgtattatcaacggccagcgtgatatcaggattctggcttgctgcggttaaatgaacaatgttggtatcgttccacttgttgatagcctgttgccaaacgttttggtaatacgctgacccagtatcaatcttatatgtaatggttgtgtccgcccaccgatatttagcaggtgtggtgttggaatcgttggtagtcctgacggaagcctgggccggtgattctgtctgctgggttgtcgttttaacacgtttgacgtattcgatggccgtgttaatttgcggggtgtcatcggtggtttcggccacaactggatgggaaagaccaaaggttacagtgacggtgaacatagtgagcagtcggatgatcgttcttttcatgagcatttctccggattaaaatttgtaacctgatatatcaaaacagttactttaatagagcattatatcatcatattattaaaacacaatactgctataacgataaagtgataatcaaacaggtcatttatcaatcacgttctcaatcaatgatgcctcaaagtgccagcatacgccacgactaatgcggtattcaaaaaagggctgcggcacaattttcattctgtcgcagcctgatgactcgctattcaatttggtaatcagaagaaataccagtcagccagataaaggcccaagacactggtcaatgcgaagacaaccaccagcgtccagacgatattacttgccaggttatgatgactcttgcgggcaaagccgatttccaataatgcgatgacggccaggcccaagatgaccttcaggctgcccagcaccggatctcgtggtacccgataaagggccagcatgaagccggaaaccaggatcggaatgtacagcacacgggtaatcatcatgaaaatcattgaaagcttatctttcagaacaaatgccaaaattgcggtaatcattaataggatccatgaaatgagatggatattcatataaagcaaaatgtaacctcctcaactgtgtttctattttagtatagtattttgccggcaaaaagaaaaagtaatttcttgattaggttctgcaaataggctattttttaggtagttgaaacaatcgaaacgagggggttgtcatcatggacgggctgaattatacccaggaatttgtgctgtgcgtgctgaatcaaaagccaaaattgagtgcattcaaggaccgcaaagtcgctgcgtgtttgttattatcagaaattgttgaactgttgcgtgctggggcgatggaattgacgcctgccaatcgaatggtggttgcccaagtgactaaggcaccggcggattatttagtgccgctcactgaagacatcaagaaacggcagccggagtcagtcaacaattatgttcgcgacgcggttctgtcggtccggaaacgccgggtcaccaagattgccgaagcgatttgtgattcgctggttaaagcaggctatctggaagttgaccacaagacctattacgataatcaaacactgacggatcgcatcttaacgcaactgtatcaagatgcgatcgctaaaaaagaaccgtcggagaagaattccatgttggcaattttgctcgtcaattcaggtttggtgcaccaaatttttcccaagcaggaggccgaaaccatcgaactgcggcttaaagaagtcatgaagtccgaccagtatcatttgatttcagatgtgaccaaacggatcaataaagatctggctgggattattgacgcggtctcatttgccaggtgagattaatcaaaaacactgcatcatataacctaaaaagtcgagataaagttttctttatcccggctttttcgtgtttattatttatgtgaatattgcgcctgcagtgcattaagcgctgtgacgtagttcatcgttggcaggttgccggccttgaaatctgctagtttgtcgtcatcaattgccatcgtcttgaaagcatccgcctcagaaaccccggcaccttctcttgcttcattgattcgcttgagtaattcagccggtaagaggctcaacagataaaggcgtttgatctgcgtcaaagtctgccggtaagcactttccggtgcggttccagcgtagtaggccttgatttcgtccgggtcaaattcgacgatattgaaaagataatcgtccgccaagtgtagttttgcttgatacgacttgatttcagccaacatttcgttaattgtcatgattcaactccattgcgttattttcaatctttcctatctatgatatgacaaatcaacgcagaattctaatcgaattaatatttggcagccaagttagcgtattcctgtggggttaaggccatgatcgaaccgtgacgcttcttgagttggccgaagtcatagtctggcgcgacctcccagtcggtgggattgctgctggttagatcagacgtcaaaattggcaggtagccgcgaccgttgtcgaattggtcgacgtaaatgcaccatttttgctgatcagccagccaaacaatttccgggccttctaccgtatcaccttgaatgcccaagtctaaatcttgaagggcggtcacctgctgccaatcgccagttagtgaaggtgactgttcaattggaattgttccgtcacgggatgcgcggacgaattggccgccagctttgaccatggtcatgtcgatcaaatcattttttggattcttggcaacggcgtaagttgcggttgattcgaagtgctggaagtctttagtgtatgcccgccagatttccattttgtgggtttgctggttgggggatgaccaaaagacaaagtaggcttcatgagccggatcataaattgcttccggtgcccaaacacagccggtgtcctcaccgaccatgcgaacggcgcgaggagtggaccaactcagtagatcagctgaatcccagaaaatcaaatccttggacccggtggtagtggctttggcctgaccccagccgccgcgatgataaatagacaggtcggtggccatgatggtgaaatggccgtcctgtctgcgcatgatgaaggaatccctgacgccgcgctcaccaatcgtcgatgttagaaccggctggttgtggttgatgtcggtccagtgaagaccgtctggacttaaggcaaagtatagttgttcagcggatgggctgtcttctgttccagtaaaaaacacgaagagatagccgccgttagtggattgattattcaatgtcaaatgctccttttttagcttgttttagtaaaaactcgttgtgaataatatagcgcttacaggtggggatgtaaatgctgttttgttgtgtgaggttgattcctatggtaaaattattgttaccatagagtaacagacggaattttgaaaatgcaatttaacagagaatatgcaaaattggcaatcaatcagattgaaagtgcatatcgtaagggtgatattttaaggcgccctggacgacatggatacggacttcattctgagaagacagaagcttacttgcgagaccacggaattacctttcaaaaggcactgaaagatgctgttcaggctctgagtacctcgaagttaacaagatttcgtggcccatctcccagttattttccgggacaatcagatggggttgtgtatgactttttggtgccgctttatgattctaatatgtacatcaagttttcactcgtcgtccgcaatgattaacaattcataattttcgaatcatttcatgagtctgatagaaacgactttggaaattttattgagttgaatgtatgacaggggaggcaactaatatgaatcctgtaaaagtaaattcagtcattactgaatatgatccgatttctgaccaaaagatcaaatatcagaaaattcaaatttctgaatccgtgactgtgagaaatatatctttcaacagtccacactactaccttgtcgaagaggggctggacattcatgatcctcagaactttgaagtcccatttgacaatcctgatgtgaatttgcgggctgattatcagatctatcgtgaaaaagttggcttcctgcaaccaagagagattaaaaaagtcagagaacatctgagattgagtttacgtgaagtgtcagccattttaggaataagttatagtacattatctgaaattgagaatggattagtattacattctcaaattcaagatacactgttacgaatgcttgaacacacctacactttgtcgacgattgtcgaacagcataaaggcttgattattaacagtcatgggctgaaagcgtaccagcgaattattgacaagttaaatgctgagaaaaattgggattcatgaagattcgatgtggctttatttttgcttaactgatgtaaatcatttcccggatatgatacgatgaaagcgtagtacattcgaataaatataaggtggtaaataaattggcagaaaatgataattggcagttaatgggcgttcgtttggatggtttgggctttgaccggagtaattttaacccgcaaaagggcccgcagatcaatgctgaaacccgtttggcattgcctaacgacccggcagacaaatcaaccatgagtgtcgttcaagttgtctcgactttcaaattgtatgacgatgaattagccaaaagctatttcacagcaaccattgccggtgtgtatcaggtgccaggcagcttgacggataacgatgctattcaaaagacaattgacgatgacaaaaacttgcgagacagcttcgcccaaccggttgtcgattacttaatcgcgaccctggcagacttaagcttaaaggcatttggcacgccaaccattttgaagcgcgagcaattgattgatactttgtttggtgcaaagcagcagtagtaggcaactatctcaatattaaaggacaaatcaacagtcggcgcaaaggtgaacactttgcaccgattttttgcactcataattaccactatgaggaatcacaccgtattcaaagctggtaaattgcgttagaatgtacaaatatgttaaatgaacgtcacgaattggaggaccacatgagctacttagagctgcataacattaaaaaatcctattaccttgccaaccaggaattcccggttttgactgggatcgacctttcctttaatcaaggggagttcgtctcgattgtcggagaatccggtggtgggaaaacgacgttgatgaacatcatcggcggcttggacagtaattatgccggcgacgtcgttttgaacggcaaatcgctccgccacgatactgccaagcaattggatgcctaccggagacaaacgattggttttatttttcaaaactttgatctgatcagtcacctgactgttttcaacaacgtcatggtgtcactgcagatgaccaaactcagccataagcagcaggaggcccgtgcccgccagctgttggaacaggtcggcttgaaagaccacatgaaaaaatatcccaatcagctttccggcggccaaaagcagcgggttgcaattgccagagcattggcatccgatcctgaaatcatcatcgctgacgagccaaccggtgctttggacagccaaaatacccaagaaattctgtccttactggaccaaattgccaaagacggcaagctggtgatcaccgtgacccactcggagacggttgccaaccacgggacgcggattgtccgcctagctgatgggaagatcagcgaagacaccaccttaaagccaggttatgagaagtctcaagccaatgagctggcaactcacacgctgagatttggcgcaaccttgaagatggccttggaaaacatgcgctataacctcaagcgaaacctgctgattgtctttggcgccgccattggaatctttagtgtgattgtcatgctgggactgggtaatggggttcaaggatacatcaaccatgaaatatactcgcaggtgaaccccaacgctgttcaggtcactaaaaacgtgtcggctgatgccagtaccgatccaagcaagattaacgtgaccaccaaagacaagaaccgattcaaggatatcaaaaatgtgaagagcatcgacgatggctactttgttcagagtggcacccagctgcgacgtggtcataaaacggcttcaatctcatttatgcagacccataataaaacgatgctgaccaagagcattgccaaggggcatgcgccaaagaacggcgagattatgctgaccaaggaatacgctgaaaagcttaataaaaagcatccatattcgttgatcggtaagcgggtcacattttatcagaacacgcttaataagaagaaacgtccggttatgctgacgaaatcactgaaggtcagcggaattgccaaagcaaataccgggtcgacctcggtcacatacagcacgatgaagtcactttacaactcaaagggcatcaagattcagcctaattttgtgaccgtcgaaatcgccggtaacgttaagaacgtcaagccggtcgagaataagatcaaggcctacaagaacgacaagaaaaaggccgcttatcaaatcaccggtgtcggcggcttcgttgatacgctgaacacttatatcaccctcgcagttaacgtcttggcaacgattgccggaatctcgctgttggtatctgccatcatgatcattgtggtgctctacatcagtgtctccgagcgaaccaaggaaattggaattctgcgggccttgggatcttcaaagggaagcatccgaaacctgttcttctcagaagccttcttcattggcttgttctcatcagctttggcgattgcgttggcggaactgctgcaggtagtggccaataacattgcccagcgaggaatcaattattcaatcatgcaaatcacccccggaaatgtcattttcggctttgtggttgccattgtcatttccttactggcagcactagccccagcggcctcggctgctcgattggatccaattgagagtttaagttacgaataatagtttgaatgacaattttaagtcctcctgcgaataaacgggagggcttttttcgtatatcatgaatgtgctgatcgaaccatgctcatgttataattatgttataacatcagttgggaggagatcgaatggctaaagttaaggttcgaaaaattggcaactcactcggggttcttctacctaaggaaagcggtgtccacgagggtgatgagctggagtacactcaagagggggacaaaattattttagacacacaagaagcgcaaaatgcgagagttagagagattgttgaaaatagcttcaaagattttgaaacaggaaatgttttgactgaagatgatatggtccgcatctttggcaagtacggttgggataaataatggatccatatgaattgtcgttctcaaacgattttcaaataagcctaaaacagacaatcgccatctgggagagcattggcattgatgccggcaaaattcagacctttgtctcagatattaataccgcagtggcttcactcaagatatttccaaatcgttttgccaacgtcgatgaaaaatatcgcattccagtaccgactaagcaaattattatcggcgaccattacgcaatcttgtatcgagtaaaggaagcgacacacacagttgagattgggccaacttataatttgaaacaaatgggtattactttttagattctcctgagagatcagcactctaagaggcgcggaaataactgattgtcagtcatttctgcgccttgtgctgcactctagtattgacaacccacccacgtggtatacaatactacataaatagtattggaaactacgtaaatatcaaaggagatttcaaatgtccgaaaagattgccattctcgctgattccggttccgatgtgccagcagaattgctgaaacaatacgataatattgaagttgccccaatgctggtgaccatggccggcgaggaataccgtgacaatgtcgatattaccccggaagaattttatgcccgcctcggccaagccgatcagtttcccaagactgccgcacccactcaagggagcgtggaagctcacgttgccagcttgaaggaacgcggcttcaaccgaatcatcggcatcaccgtttcggcacatctctcaacgacatttggcattttcaccaatgtggcaagggaaaacgccgacatcaagatggacgtgatcaataccagaaatattgggattggcagtggccttttcgcggtctacgctgaagaaatgattgacagcggtcagacgtttgacgaaacaattaaatttctcaagcagtctgttgaggacagccggacgtttttctatattcccagcttgaaatacctgcgggcaggtgggcgtatcggccgagttgccgggctgatcggctcggtgcttaacattaagccggtgatcgcgaccgactctgaaggaatctatttcccggttgccaaagcccgttccgagcagaaggccatctcgaaaatggttcagttggtctctgatataatcgccagccacaagagtgtccgagtcggcgtcgctaatggtgccgacgtgcccctgcaggaaaaagtctatgatcgcttgcactcggccttcccgcaacttagaatatatcgaggaagcgtttcgcctgcgttaggggttcacactggtcccggcttggttggggttggtgtgcaggtaggcgaaggcgaataacgaaggaggggttcgatgccaaaaacgaccaccgagcttcagattagattgccaatgtgggaagaactgccggcattttcactgtacttggaccagctgttggatctgaccaacgagtatctggaaccaatcatcggcgacaaaattaccaagaccatgctccacaattatttcaaagctaaaattctggtgccgccggtcaaaaagaagtatcagcggacgcagctggccggcgcaattgtagtggggctgctgaagaacattttcacgttaaacgaagtgaaggccggcctgatcaccttattgggaaatggcacgcccaagaccggctacaataattttgtgattatgtttaacgagcaggctgccaaggccggcaaggaattgtcggaccccaccagcttggaactggcttcagccggccagcccactttgatgcagtatgatgccgtccagtcgatattgttttggctgtcggcgaagaatcgattacatgaaatgatggatccacaagaccgtgatggcgcttaggcgtttgtcacggtttttattatggcgacatatattcataatgggtcagtcaataactttattacaaatgtgtggaaatcgggtttgccgtgaactaagatagtcatgtgtgaattgaattcgttttcatttattattgaatatttatggaggggtaaatttgaatagtaatcataaaatgttattgagggagttctctattggggcagcagttatggcagcagtcgcattaagtgcacccgctctgacgaccagggcaagcattccaactaatcaaaacgtgtcaacgttaaactcaagtaccaaagttcaatctggccattacaccgaagataattccgaggacaattatcaatttgactggtctctcagtgatgatggaacattgacgttatctaatgcaagttttgtatttggcggtaacaattcgccgattaattcccacatctctaatcaattacctgccgatgtggtgagtgccgttaagaagatcgttctgactggtagccccgttgcaagtgggaatatccaatacttgttttgtcactttgccaatgttgaaaatattgatgttcacaatttgaatgtttctggtgtaaccagcatgcaggccttgttctgtgaaaatcaaaagctcgattcggtgaacatctcatcatgggataccagcaatgtttcaaacatggctacgatgttctgggaagaccctatcacgaccattactggtttgaatgatttgaaaactggtcaggttaccgatatgcatgaactttttgcgacaagtaactctgcagacaactcgaaggtgactcagctggctcaaagttttattaacactgcagatgtacacagtgtaaaaaactttgaaggattattcgataacagcaacatgatcaacctggacatcagctcgtggcacatggatgctgccactgacacttcaaatatgtttggggattaccaaattgcccttcaaagcccattggtaagctacaccggctctaaaatgaccactttgactttgggacccgatgacaagtttgtaccggtttctgagccaactgctgttgtagcaccaacctttaacccctttggatccacacaaacttacgttccagtaagcctaccttctggaacgaccatcaatatgcctgtcgataaatcaggcgactgggaggccgtcggcagcggaacggtaacgaatccacaaggtgccacttggacaagtgctgattttgacaccaaatacgccccaaccgccacaccgcgcccagccaaggaaacctatgtctggaagcacacggcaccaaagctcaacatcaatttgaaatcgccagttactttgaaacagggcgccaaatttgatgctgacagctactttgtttccctgactgatgctggtgaaaatgccattagtgccccgattaccagtcttaaagacgctgaagcattggggatgaccatttctggcgctgacaaagtcaacactaaggttccgggaacttacaacgtcactttcaagttaggcagtcaatccgcaactttaaaggttacaattcccggttcttcaagcaacggtggcaattccagcaacagtagctcatcaactaccccagctagcaccgccccaagtaccaacaactcatggaacccaacgacaccaaatcaacccaacggcaacacgggcttaccgaactacgctgctgtaaaaggtgacgccgtatacgccactaaggccatctacatgtacagctcaccaaacttcaccaagcataaccgaattgccaaatacaccaagaagacccgggctactcggccgatgtttgttgtgaccgggtatgacaagtccaatggtggtgctttgcgctacaaggttcgtgatgttaataagggatcgaagacttatggtaagtccggctacgttactgccaataacaagtatgtcggcggcgcttattatcagactatgcccaagaacaagaagcttaccgtaattgctaagcacgggatcaattcctatcgctcagccagcttgaccggcaaatccaaacactacaagaagggtgctcgactgcacgttaagaagcttgtgaagcataatttgaccacccgttatcagttaaccaatggtcattatgtcacaggaaataaaaagtttgtcattcaaggaaattactaatatcagccaatagggtataccctaacaaagttatccggaaatggtgctaccccacctcaaaacggtgtagtgcaaacgttaggaacgtttacaactgatggcgcaaatgctaaaacggcattcagttattcacttctggctaataagtttgcggcgtggacgacaaactcagtgggatcggtgtatgtactgagagtaatgtttgcaggtacaggtgggcaaaagagttttaatattcggattgtctacacagacgggttactcagtctgactgctccttcaaatattgattttggaagtgatttgaatgctgaattcactggaaacccaatctatatgggaaaggttgctactggtagtcaggcacttgaagttactgatacccgtaaaattccaactggatatcctataaacggatggaatttgacggttgctttaaaaaaacaaatgacaggagtaacaactaaaggtgttttgacaaatagtctgcattatatttacaaagggacggataacacgctaagttctgcttcaagcccagtgatgagcttgaccactggaacaccagggaaaacaacgcctgtttcggctgtgtgggattctaaaaatggaatagcgtttgagcccacagccggacaaccagttgctggtgaacaatatacaggtgcggttacttggacgttgcaggatgcaccggttaatcagtagggagatgatgccatgtgaaaagaggattaatacttgtgatactgagtgttgcgtcgatgtgtttgtttaattcaccgatccgtggtgatacccacgtttccgaaagttatgtgggatttacgaaggcagcacctgcaacgccgcaacctaatgtgccggacaaacccatttattcaaaggtagaaacggcatcacaaggtaaacaacaatatttgccgcaaacagatgaacagtcagaaattttattgagtgtcattggattatcaggaatgattgtagttcttggatatgggattcagagaagaaggatttttatagcagccaaataagtaaaaggataaaccaaaaaaacgaataggagccactccgacttattgctatagcaattagggaggatggacatccgtatgagaataagattttacgaaagtaaaataaatctaaaaaacgaataggagccactccgacttattgctatagcaattaaagaggatggacatccgtatgagaataagattttacgaaagtaaaataaacctaaaaaacgaataggagccattccgacttattgctatagcaattagagaggatggacatccgtatgagaataagattttacgaaagtaaaataaacctaaaaaacgaataggagcgattgtcatgaaaaaaacaactttaatctcactaattagtatgagcggtcttgttttaggagctattgcaccagttactgcaatggcagcagaaaaccgtactgaagacacaaccgcatccgttacatttaaagaaaacacgactcacccagttgatccggtcgaccccacagatccagatgaaccaggtgatggaagtggaactggcgaagttggacctttaagtattgattatgtttctaattttaattttggaattcataatgtgccaaccgaagatgcggtttatacagcagaagatgatgaaggggctagcaaaacatttccaaactatgtccaagtttcagatcaacgagctggggaccctaaaggctggagcctaaccgttagtcaaaaaggcaacttcaaagatagcaaggcaaatactttaacaggtgcgcaaattcttttaggctcggcaattgttaaaacaaccacgaatagttaccctagctcaaatcatacagtaacttcttctactaatggtgcggcattacaacctggaggtgctactgtgaatgtgatggctgcaaaagctggtggtggttccggaacatgggttgatgtttttggacaagcaaataactcaacagtaaaattagaagttccagctgcagcacatccaaatgcggatagctatagtacaacgctcacttggagtttagcagacacaccagttaattcttaaaataattaggtaaaggaggttgtcactgtgaaacgaaaaacttttatcttgatactaatgactttggtactaagtattctcacaatcttgccggtttcggcaaatcagctaacctttggagttcaagcaaaccttcctgaaaatcaagttgacaataaggttacctattttgatttgaaactaaacccgggtgctagccaaactgtaacggtcacggtaacaaacgggactaaaaaacaagtcaagataaaaccggaagtaaatacagcgacaaccaatctaaatggtgtagtcgaatatcagaaagtatcagctaagaactttgattcatccctgaagtatcctttgtctaaatatgtaacgccagtcgaaaaaacgattgtcttaaatgcaaaacagtctaagaaaatccatttcaaaatcaaaatgcctaaaggtaagtttaatggtgtaatggctggtggcattcgtcttcaagatgaaaatgccgagattagtaaagatgctaagaagaaaaaaggaacaactgtccaaaatgaatatgcgtatttagtgggaatagtcttacaacaaactgcaaaaaaggttacacctgatatgaaattggcaagtgtcaagccaagtcaaaacaaccttcgaaatgtaatcaattcccgtttacgaaatgttaaggcaacttatttaaataaattgtcagtaaatgcaaaagtttccaaagctggtagttcaaagattttgtatcaccagaagacttctaatatgcaaatggcacctaactcagttttcaattatgcattgaatttaaatggacaaaaattgaaggctgggacatatgtcatggatatcacagctaaatctaaaaagcagacttggcattttaaaaagcagtttacgattactcgtaaaaaagcggctgtgttaaatgcaaaggatgtctcaattaaaaagaattatagctggatttatatctcggtaggagtcctcatcttgttaatcatgatcgcaattgcattctggctgatccgtagaaaactaaaagctaaagaagctgaaaacgaagcattacgcgcccaacttgaaaaacactcctcagacaactaattgtttaatgaccccctttgcaaataagactggaaatttccagtcttatttgtttattgtttcaataagtaatactaagctggtaaacttaaagaaaagtcgaaagaggatttagctatgtggactcaatttaaagaaacaaatttttttaaatttatcacaatctttttgcgccgatttaaaagtggaaatgtgtcgaacaatggaattgtttttgcgtattatactttgctctcattctttccgttacttctgttaattggaaacctgttaccattactgaatttgccgataaaaaccgttctagaatatgtgcaacaggtcatgccagaaaatatttatgaaattttgagtcctttaattcgtcagttattgacaactaatagtggcggcattttttcgataggagttgtggtggcaatttggtcggcaagtcgcggcatttcggcatttcaaaaatcgttggatgcgacctatgaaatggagaattctgcaaatgctattctgagtcggctgttgtcttttgtgattgtccttatttttatgttggccttggttgtggtcgtcctgttcttcacattaagttcggctgttttgacttatttgaccccaatccttcatctacctcaaaacttggtgggcatcgtgagcacagttaaatggccgattaccattattgcggctgtcattattttggctgttttgtatgtcattgtgccaaccgcaaaggtctattggcggtttgtctgggttggtgcggcgttttcgatggttggtttactgttgctaacgcagttctttgcgctatatttacgttactttggcggcgaaattaccacctatagaacaattgggacttttattgtgatcatgctgtggttggatctttttgcggagattctcttgattggcggggtcatcaatgcttccttacaagaaggctggcagaaaaaagcgtttatccccaagaaacgccgttcaaaaaggcaaaaatctgataaactggtataatacaaacataaattaatgtaccgggaattttggttctcggatgcagctaaaggtgtgaaaattacgaattttattaaaacgcataaagctttaacgactgatgtcattttgattttggctgggataatcgattggttgattacgcgcaatttcattgtgactagcaaccacttttttatgattggattggcgctattactaattggtgtggcctttgtattagaacgaggacatttactaacggggtggtttcgccggccagctaaaggtgaagaaaaactgaagcgaaaaaagatcgatgttcacaaagtcgggcggattaaaaacagtccaattgtgtttacaaagccagcacgctattttttacgcattgggatttttactgttgttgtcagtattcttgtttcatttatctaaaaaactctttaccaaatgatttttgaagtcattggtaaagagtttttgtttggaacctaagtagttaacacaaatttttgaatagctttggcaacgccgtcttcttcgtttgtggcagttacaaatttggctaattgcttggcttctggaattgcattacccattgcgacgggagttccagcaacttttaacatagaaagatcatttccttggtcaccaattgccatcatattttcagacgtccatcctaaacgtttcgccaaatctttcagcgcgttacctttgctggccgatttatttaaaacttctaaaaagaaaggctcactttgcacaaagtagtatttctctaaaaagctttgtggaatcttttcacgcagagcggtgatcttttctggtgggtcaataaacatcccctttggaattcgtaaattcattggcatttcaccgacatcacgataccgaatacccatgcgcacgtaaaaactttctgcaattgtgtaaggactcagattcttattggcagtataaatatggttttcagtttctacatgaaaatgactgcgcaatttccgacttaaggcttcaagatcagtatagtcattgtagtttagagtatgccgaataatggtccgcccctcgattgtttgaaccagcgcgccattgtaagtaatgacaaactggttatcaccagacaagcctagtttttttaagtgttcagcgaccccagtaagtggtcgtccggagcataaaacaattttgacaccaacttgactggcctgcttgataacagaaacggttttgtcggtaatttgtttattgtcggttaaaagcgtgccatcaaggtcaatggccacaattttgatcgccattagcgttgacctcccttagcatctagcaaaattccgtttttaatatacgattgaaactctttgtaaattgggtggaagagttcactatcatcttcagatagcatttttttaggaaagaagaaacgttcatcaccagaaacccgtcccgtgatcgcagccactaaagcactcacggttgaaagttcaactaaactaccatcgtgttgcataagctcaatttgggtccgtggtttagtggtgctaggatcgtaagcatcatatggtaagtcatagctattattgatagctgtgtagtaggtactgttaaacccagctttttcaatgaggcttcgcagctcaggtaataaatattctgtttcgcgcgtaaagcgtactgatttcagtgggatacgatttaaaaatcgatttgataaatcatttaaaacgggatctttatcgtcctcccactgttggaagtaggtgtttaaaacgccatcatctaaacgtaaataatcggcaactgttgcattgtgattaaaaaacggcatcaaaaaataaggaataaaatcgcgttgcttactattatcattggtagcatcgccataaatttcgtttgctcgttgcaaaagatgacttaaaatcatttccattgagcgagaaacaggatgaaagtaaacttgaaggtacatttggaaacgactgacgataaaatcttccacggcatgaatgccgctgattgaaaaggcaatgccatctttataaggacgcatcacgcgcaaaattctggttaaatcaaaagtgccgtagtttgtgcctgtgtaataggaatcacgaagcagataatccattcgatcagcatcaatttggctagagatcatttggacaacctgtggatttggatatttatgagagatcacgctggcaacttcgctcggaaactttggtgaaactcggcggagcacttggttaacctcggtttctgggtccgtaataatgtgttcggtatagctttcatgatcagtatgaaaaatatgctcaaatgtatgtgagtatgcgccatgaccaatgtcatgcagtaaggcagcacataaggtgacgagacgttctgaattgtcccataaaccatcgccaggtgtctttgagggatagttacgctcaaaactgtcacaaatgcgccgggcaacttcataacatccaagggagtgtgagaagcgcgtatgttcagcaccatggaacacaagtgaagttgtaccaagttgatgaatgcgacgtaaacgttgaaattcttttgtattaattaagtctaagatgacctggttttgaacataaacatagttatgaaccgggtcacgaaataccttttccattggcaataatttattacggtaatccatgaaaataggcttccttccatctaaaagttatttgttaagcctagtataacaaagttttgtaattccgtttgaataaagccaaatcgctatgatgaatgaatttttgggtttatactaataaggaagttatttttgggaaagaagggtgctgactttaatggatgaacttaatactggtgtaccggttgccattcatttggacacttatatcacacaagaaggagaagagtcccattttgcatttgatgaagatggtcaactttttcaaatgggtgattctttttatattcgttaccaagaaacggatgaagataccaaagaacaaattccggtcactatgaaaattgatagtgaaggagacgtcttattgacgcgttccggtgaaaacaaattgcgattacgctttagtaatggcaaacgaattcaggcccgttatcgtacaccatacggaattttaccggtcgatacagttaccccgtttttggaagttcgtgtgcgtgatcgaccattttccggaactgtgaatgtggattaccagttatttgctggtgaaagtttattaggagactacaaaattagattgcaatttacagcctaggtaatgtatcatagggagtagactgttgaaaggacgtgcaccagtttggatttgaaaatttttgatggtcaagacaaaactgaactttcattaatcgaggttgctcatgcaattcttgctcagcatggtgatcccatggcatttgtggatcttgctaatgaagttcaacagtatcttggcaaaaccgatgaagaattccgcgatcgtttgtcacaattttatactgatttaaatactgatggtagtttcatttctttgggcgacaatagttgggggttacgtacttggtacccctttgagtcaattgatgaagccattattcatgctgatgaggatgaagatgacgatcgtccaaaacgtaagaaacgtaagaaggttaatgctttcttagctgacgccgcagatgatgacgacgtaattgattatgatgccgatgatccagaagatgatgatgttgttgctgatgacgacaatgactttgattccgataataatgatgattatactgatagttcaaaagatgatgatagtgatgatttacctgatgatgatttgcccgatggtatcgaaggacagttatctgagttagatgatgacgattcggatgatgatgaataagtcagcttttcaagcttgacattagattagttaccttgtattatctttattgggcgctttgctatgtgcaaagccaaacagtacggattttaaattgtgctccctattccaaatgaatagggagcatttttattatttcataaatgtccctaaaaaacctcaaaggagttataaaatgactaaatacatttttgtcactggtggcgttgtttcttcgcttggaaaaggaatcgtagcggcttctcttggtcgtttactcaagaatcgtggcctaaaggttaccattcagaagtttgatccctatattaatgttgacccaggaacgatgaacccgtatcaacatggggaagtatttgttacagatgatggcacagaaactgatcttgacttaggtcactatgagcggtttatcgacaatgatcttaacaagtattccaatgtgacaactgggaaaatctattctgaggttttgaaaaaggaacgtcatggtgactacttaggtgccactgtgcaagtaattccacatattacggataccatcaaagaaaaaatcatgcgcgctgggacaatcacagattctgatattgtgattactgaaattggtggaacagttggtgatatcgaatctcttccattcttagaggctttgcgtcaaatgaagagtgaagtgggttcggaaaatgtgatttatattcacaccactttgattccttatttacgtgcagctggagaaatgaaaacaaagccaactcaacacagtgttaaggaattgcgtgggcttggaattcaaccaaatattttggtagttcggactgaaaagcccattacacaatccatgcggaataaaattgcgttgttctgtgatgtagatccagaagctgttattgaatcacgtgatgtggataatttgtatcaaattccgttgaatcttcaggctcaagggatggatcaaattattgtggatcactttggtcttaagacaccaaaagctgatatggaagactggcgaaagatgacagaacatgttcgtaatgatttggaccatgtcattaagattgccttagttggtaaatatgtggccttacaggatgcttacatttctgtatctgaagctttgaaacatgccggatatccagtcaatgctaaaattgaaattaaaaaagtggattctgaaaaaatcacaaccgataatgtttctgaaattcttggcaacgtagatggtttaatcgttcctggtgggttcggtgatcgtggaattgaaggcatgattacggccattcagtatgctcgtgaaaatgatttaccattcttgggaatttgtttaggtatgcaaatggcttccgttgagtttgcgcgaaatgtcttaggtcttaaagatgctaattcaacagaaatgaatgctgatacaccgcataacattattgacttaatggccgaccaggaagacgttcatgatttgggtggaacacaacgattaggcttgtacccatgcaaacttaaagcaggttctgtggctgctgcagcatatgacaatcaagatgttattcaagagcgtcatcgtcatcgttttgaatttaataataaatatcgggatgctatgcaagaacatggattagtattttccggcacttctcctgataaccatttagttgaagttattgaattacctgaaaagaaattctttgtggcttctcaatatcatccagaattcttatcacggccacaacgtccagaaggtttgttcaaagcctttattgcagctgctaataaataacagtaaacaaagtagtacacgatcgtcaataagacatagtcgtgtactatttttgtgaataaatttatagaaaaattaggtcaaattataagtttttcgtgaataacccttaggcgggttcggtttattgtttttttttaatttatggttgtttttttgatataggttatttatgattagaattgactgtacaattattagcatgttgataagtgaggaaagtacacatgaaaaaaatggtaatccgtggcggacaacaactttccggtgaagtgacaattggcggtgctaaaaacagcacagtagctttaattccagctgctatattagccgatactcctgtccgcctagactctgttccagacatcttagacgttcataatttaatgatcattcttgaatcaatgaatgttcattctacgtttgaaaatggtgttatggaaattgatccaactaatataattgaaagtgccttaccaagtaaggcaattaaaagtttgcgtgcttcctactattttatgggggcattgctaggtaaattcaaacgcgcaacggtaagtttcccaggtggcgacaatattggtcctcgtccaattgaccaacatatcaaaggattcaaggccttgggtgctacggttaacgaacaaaacgattcggtttatatcacgactgataaccgtgaattacacggtgcccatattttcttagatgtcgtttctgttggagcaaccattaatgtcattttggcggctgtcaaagccaacgggcaaacaacgatcgaaaatgcggctcgtgaacctgaaatcattgatctggtgaccttcctaaatagtatgggagctaggattcgtggggcaggaacagatgtcattcgtattgatggtgtggatagtttgagtagtaatgctactcacacaattattccagatcgcattgaggcgggaacttatttgtcattggctgcttcagtgggcaacggtatccaaattaataacatcattccagaacatttggaatcttttaactcaaagcttctggagcttggagttgatttagatgttggtgaggatagtatttatgttcctgaatcgcgtaatttacatgccattgaaataaaaacaaatccgtttcccggctttgcaacggaccttcaacagcccatcacacccgctttaatgaaggctcagggaagtagtgtcattgtggatactatttaccccaaacgtgttaaacacatctcacagctgcaaaaaatgggtgctaacattagagttgaaaatgatattattattgtggcacatacagaacaattacatggcgccgaggttgaggctggtgaaattcgtgccggtgcggccttgatgattgctggcttgatggcttcgggaacaacgattataactaaagctgagaacattttgcgcgggtatgatcgcattgtttataagctgaagcaactgggtgccaacattgaaattgtgagcgatgcagaagaaaaagttaaatagaggtaaagaatgagcgattttttaacaatggcggaattacaaaaaatgacgctcaaacagatctatggttttgcgcgtcaatttaagattccgtattatggtcagatgaacaaaccagaattagctttagctatcattcgggctcaagctaaggaacaagactttgtcgaaatggaaggcgttttagatatcgtctcccaggaaggctttggttttttacggccaatcaattatgggccttctcaagaagatatttatatttcggcttcacagattactcggtttggattgcgaaatggtgatcttgtcacaggaaaagctcgacaccccaaaccatctgagcgttattatggcttgatgcacgttgatcgagtaaacggaaaaaatcccgaagaagctaaacaacgacctcatttcccggcattaacacctatttatcccaaacaacaaattaaattagaaacaacctcggaaaccttgtctacccgcttaattgatattttcacaccaatcggttttggtcaacgagggctgattgtggccccacccaaggctggtaaaaccactttgctaaaatcaattgccaatggcattgctaaaaattatcccaaggttaaactaattgtgttattgattgatgaacgtcctgaagaagtgacggacttggagcgctcgattaaaggtgaagtggtatcttcgacttttgataaagagccgaaaaaccacattcgagtttcggaacttgttttggagcgggcactgcgcttagtcgaagacaaagaagatgtggtcattttactggattcaattacgcgtttaacgcgggcatacaatttggtgattccacccagtggtcgaacgttatccggtggaattgatccagctgcgttttataaacccaagaaattcttcggagcggcgcggaatattgaagaaggcggcagtttaacaattttgggaaccacgttggttgatacgggaagtcgcatggatgatgttatctatgaggagttcaaaggaacagggaattctgagttaaccttatcacgagaacttgcggaacgccgtgtttttcctgcgcttgatataaaacaatcaggaaccagaaaagaagaattgttattaccacagaatgttttggatcaagtttggcggattcgccgtgctatggtgggtgattcgcttgaaacaacggaacaattgttacaattcttgaaaaatactaaagatgatcaagaatttttaggtgagattgaaaatgtgaagtttaaatcagccgttcggaaacgaaaaccacggtaaaagtgagttgcgtgtaatagatattcatgatattatagtggtcgttgattaatttaagaaaataactatgtctcagtaaatgactcatggcaaaggagcgtatttataatgaaaaaaggaattcatccagattatcacgaagtcgtatttcaagattcaacaactggttataagtttatttccggttcaacaaagacttctgctgaaacaatcacaatggacgatggcaaagaatatccattagttcgtgttgaaatttcttctgattcacacccattctacacaggtcgtcagaagttcaaccaagtcgatggtactgtcgatcgtttcaacaagaaatacggacttacagacgacaacaagtaattctgtacttaaaaaagctcgaaccaactgtgacgttgattcgagctttttgttttgggttaatgtttgcggtcggcgtgcgtgttgatttgaaccaaaataaaattcaaagcaactaagactgatgtggaaataaagacggatccgtaatcaaaggttacagaaactgcagatccaattaagggaccggacatgtttcctaatgcttgaaaagattgattccaactaaatacccgacctgttacttcggcaggcgagcgttttgacaagattgcttgaacggcaggcaacatggcgacatccgaaataccaaccataaagcggaagaaagccaatagccaaactgaactaacaaatgccattggaatgtacatacaaatggcaaaaataaaaccaatggaaagaattttttcagtcccgatatgatctcctaattcaccaagtcttggggcagaaaaaaacgttgcaattccaggaacggcagctacgattccagccacaagagtgatcgggccaattcctttcattaactgccgcacgtaaaggcttaaaataggcgtgattgaattattggaagcttgaataatcatggttgtgataaacatgccaaacacaattttaggattatctaatttgccgatgacttctttagcggttaaaggttttgcgcgttctacaggatggaaatgttcatgcacaaagaaatagctcaaaaagaaaacgagtaataagacggccccggtaatgaaaaaggtaattcgataagagaaaaattctgctaaaattccaccaagtaaggggccaatcaagttaccactgacatacccggttgataatgttcctagagccaaaccacttttttctttaggagtttctgtagctaacaaagcgttagcattacttatgtacccggaaaatacaccttgaaccatccgtaaagcaattaattgccaaattgtttgaaccaatcccattgcgccaattacaaatgccatgccaagtgaagcacgtaagatcattagttttcggcctttagaatcggcaagttttccccagattggtgaaactaaagcggtaactaaataggttgcagaatatgtaatcccactgtagaatgtaagttgttgcttggaaaaattgccaagtgtgtcgacatataaggataaaaagggcatgacttcactaaaagccatcccggccataaaagtgccaaaccaaaggacgactaagttttgttcccagggtgctcgttttttaaatatggatcttttaattttagaaaacaaagccatcctcctttctaaacgaaattaggttaataaaaactatatttattagaataccactatttaggttacagggagaagaacatgaaaaaaaagggaaccaggattagaaaatggctaaccacaattttaattttaattttgttgcttataagtttggcgttaattttcaatgaacagatcaaagattggttagttgattcttataaaccacaaattacgcagcaaacgattaaaaagaataaaaataaaaaagctagttacaatttcaagagtgttaagtcacttgattttcaaacggttgcgaaggcacgcgctaattctgctaagttgaatgtggttggggaaattagtattccaaaaattaagttgaatttaccaattgcagagggggtcaccaatgaaaatttggcattggcggcagcaactttgaagcctaatatgaaaatgggtaaaggtaattatgttttggctgggcatcacatggtgcgaaaagacattttatttagtcctttgtattggaagatgagacccggaatgaagatttacatcactgatctaaaaagaatatacacgtataaagcaacgaaaaggcaatttattgcagcgacgcgtgtggatgtgattaatgatgtgccaaacaaaaaaataattacgttaattacttgtgatgcaactggtgccaagcgtctcatgattcgcggaaaatacgagagttcagttgcatacaagaaagcaccaaagagtattcaaaagagtttttcgaaaaattttaataataaataggcaggtcatgtgactaagtaacccttattcacatacttgagcgattagaatatatcatcttaaaaacgactgggaaaactttcccggccgtttttagatttaaaatgaagagaaatctaatgtgacttatttttcactatcgcagttggttaagtagtcaagccaattgtcaataccagcggcgatttgttggtaggcggcttcaaatttatgcgtgtaccaaggatctggaacatcacttgccggatttttagatgaaactgacataaaaagtctgagttttcctcgtgagtttacgggttttaatttttgcaaatcctgcatatttttatgatccattccgataatcagatcaaagtttttaaagtcagtctttgtgacaggacgagaaattaattgtttggtagataccccatgattttgtaaagttgcaattgtttggggatgcggtgggttaccctcttcccagtcactggtaccggcggaatccacactaaattggtgcgtcaatccagcttgaattattttttggcgaaaaatcgcttcggccatgggagagcgacaaatatttcctagacaaacaaataaaattttttgcataaataccacctaatcttaattatttttgaattcattgcctaacgctttataaacaacccgccgtctggtattatcaaggtattaaaacgaagaggagaattagtatgacagtaggaataataattgcagtaatcgtcgtcattctaatcggattgtttattatattatataacaatttggttaaggccagaacttatacacaggaatcatggagccaaattaatgttcaattgaagcgtcgaaacgatctgattccaaatttagtttctacggttcaggggtatgcttcgtatgaaaaaagtaccttatccaaagttgttgagttgcgaaaccaattggtgtctgttactgacaacccccaggctagtgcaacggatcgtgcacagacaatggctttatcggatcaattaagttctcaattaaaaagtgtgtttgctttatctgagagttatcctgatttaaaggcaagtgctgagtttacaaaacttatggaagagctaacaaacactgaaaataaaattgcttattctcgtcagctatataattcaagtgtggccagttacaacatgaaattacaaacatttccaagtaatttggttgcttcgatgacaagttttaaagaagcaacttatctacaagttccagaagaagaaactaaaacacctgatgtttcttttaaaaagtacgaagatttataaaaatcagtaagcagagaaggagttgataaacagtgctattccaacaaattgcacgtaataaacgacggactatttacgtcatgataggcttcagcttgctcgtgcttcttattggtggtgcgcttggatacttcttctatgatagtgccatttcaggcattatcatggcggctgttgttgctggaatttatatgatcatgatgatttcacagtcaacctcagtagtgatgcgaatgaatcacgcgcatgaagttacagaagcacagcaacctgagctttggcatattgttgaagatatggcgttagttgggaaagtcccaatgcccaaagtgttcattattgatgatccaagtccaaatgcatttgcgacgggaaacgatccaaagcacgcagccgttgccgtcacgagtggtatcatggagcgactgaatcgtgaggaaatggaaggcgttttaggccatgaaatttcgcatgttcgtaattatgatattagactgcaaacgatcgcccttgcgctgtcggcagctatttcaatgttggttaacattggcatgaattcgttttggtggggtggcggtcgtcgccgaaataacaacgattctgagggtggtaacatacaaataatattgttgatattatctgtagtgctcattattttgggaccccttgctgcttcaattgcacaaatggcattgtcgcgaaatcgagagtatttggccgatgcatcaagtgtagaactcacacgaaatccccagggtttgatcacagctttagagaaaatttcggatagcaaacctatgcaggcagcagatccgacaagcgcggcgctttatatttcagatccgttaaagaaaaaaggtgggttatctcatttgtttgatacccatccgccaattgaagaccgaattgcaagacttcaaaagatgtaagttatttagcaaaatttggcgtacaataataagttgaacagataattcattgaaagtgagctattaagattatgcgggatgatttcgtatatatccacttggagcccattgcaaacttgatttactcaagaggactaagtgtcgaagatttcctacgtggtattccccgaataccgacgcatattttggtgttgaatacaccgattaatgataatttaagtattgatccccatacgcagttaaatacagtgagtgggacttttaacattcgaaaatatttaactaatccaaaggccattcatacgagttggctagattattcgcgtgatgagggactggatgaacttcttccggaagaaattgcagaattgctatatctaggccatatgcatacccattatacgacgccattttcttataaactgcaaaacgattttgtttttctttctttgggaagtaaacatttgaaagtctactaccgccaattgaaaaatttttatccagttttgaatggtgcacttattcggcatacaaagcaggcttttaatgagcgaagaatgtttcggcgttacgatgggtttcccgagatcccacagactatgttgcgacagttaacacctattctaagtagtggaatcatttttgcttttgatcaagcattcgaacaagaaaagcagtaccgaattccaattttgattgctcaagaaaatgggcagtcaccaatttatcgtagccgaacgtcactttataataaggcgcagcaagtagctgttttacggtataacatggtgagcagtcattggcatttagttattacaaattcgcgcgcttttgaagatgatcagttttattaattaataacaatgtgagaactgactggttcagttctttttattttgtaaaacgaagataaatagttagtgtggtataatttaagggttctaaattcgagattaggagaatggataaaatgaaaatgcagttgacagaaattgccaatgcggttggaattgaagaagtacctgaaaattggcaggaaattacaattgcaaacgttgagtttgatagccgtaaggtgcaaccaaattcgttatttattccattaaaaggtcagcgtgatggccatgaattcgttgaaaatgctatgaaaaatggtgctgtagccacgctatgggcaaaagaccatgaaaatgtaccaactgggtatccagtcttggtagtggacgatccacttgaaactttgcaaaaattagcagtttactatcttggcaaaattaatccaaaagtggtggcaattacaggtagtaacgggaaaacaaccactaaagatatgacggctgctttactggaaactgaatataatgttgtaaaaacagaagctaatttcaataatgaaattggggtaccaatcactttattgaatatgaatgctaacacagaggttgtagtggttgaaatgggaatggatcgtcctggtcaacttgattttttaagtaaaatggcccagccagacacagtggtaatcaccatgattggagaagctcatattgagttctttggtacccgtgataaaattgcggatgcaaaattggaaattacccatgggttaaaagaagacggtctatttatttataatggtgatgaacctctcctaagagaacgaagtaaacaagttgagcaacaacaatacacgtttggtagtagtgccgctgatgatttgtttgctagcaatgtgcaaagtgctcgtgatcatacaagttttgaaatcaatttagtaccggatcaaacttatgaaattccaatgattggaaaatataatgttatgaatgctttagccgctattgcagtggctaaggcctatcatatcgatccggcaaaggttggggatgcgctaaaaaattttcaacttacacataatcgaactgaatgggttcgggggagtgctggtgagttgattttgagtgacgtttataattcaaatcccactgctgccaaagaagttttagcttcttttagtcaaacagagatcaaaggtagtcgatttgctgttttaggtgatatgttggaactcggtgagcaatctgatttgatgcatgctagcttggccaattatttagatccaaaactaattcaagatgtttatttagttggtactcatatgaaagccttagaacaagctctaaaagcaaaatatgctgatgatcacattcattggtatacggtggagcaagaaaatcaattagttgaagatctgaaagaaaaattaactaaccaggatgaaattgtgattaagggtagtcatggcatccatttggaaaaagttttatcaggtttacaaaacgcatagtaagacattattgagcaaatcggccatattggtgcggtttgcttatttgtatgtgcgggtgtatgatgttaaggttatgtttatagctgtgacttctcagaattgcaggataaaaggacggattttcttttggattctgaaagaagcacgatttcactaggaggaaaattatttgaagtttacagatttcgatttatcggatgcgttgcaaaagaccattcaagaaagtggttatgaaacgccaaccccgatccaggaacaaacaattccccacgttttagctggcaaggatatcattggccaagcacaaacaggaacagggaaaacggcagcttttggtttgccaatcctggaacacgttgatgttgataatctcaacgtgcaagcattagtagtctcacctacacgagaacttgccattcaaacgcaagaagaattgtatcgtttaggaagagcaaagcacgttaaagtgcaagtcgtttacggtggagcagatattcgccggcaaattaagaacttaaagaaccatccccaaattattgtgggaacaccaggacgtttattagatcatattcgtcgtcatacaattaaattagaaaatgtccaaaccttagtgcttgatgaagcagatgacatgttggacatgggatttttgcctgatattgaatctattatttctgaaacacctgatagccgtcagacattgttattctctgctacaatgcctccagcaatgagaaaaattggtgtgaagtttatgactgatccagaacaagttatcgttaaatcaaaagaattaacggctgacttggttgatcagtattatatcaagtcaaaagaattcgaaaaatttgatatgttaacccgtgttttagatgttcaaaatcctgctttggcactggtatttggacgaacaaagcgtcgtgtggatgaagtatctcgtggattagaaatgcgcggatacaatgctgctggaattcatggtgatttaacccagcaacgtcgttctagtattttacaaaaatttcgaaatggtgaaattgacattttagttgcaacagatgttgcggctcgtggattggatatttctggagttactcatgtttataactatgatattcctcaagatccagatagttatgttcatcgaattggccgtacaggccgtgccggagcacatggtgtttcagttacgtttgtgacaccttgggaaatggattacctccgtgaagttgagaaattaactaagaaacggatgttaccacttaaaccaccaacaaacgacgaagccttccaaggcagagttgcaattgctgaaaaggaaattgaggatcttgtttctaagactcacgaagaccaatttagtgatcaaacaaaagaattattggaaaaatacacgccagaacaattggttgctgccttattaagcagtaaaactaaggctgattctagccaagttaaggttcgtattacaccagaacgtcctttgcctaaacataagggcggtaaaggcggaaattatcatggtaatggtcatcgaggtggcggttatcgtggtaacaacaaacgtcgtagcaacagtagtagcagctaccgtggcaaccgtgataacaatcatggtaagtcatctaatcgtagccatggcaactacaagaaaaacagtggtagcagcaataacagcggaaaccgtcattcttcatccaatagtaaatttacaatcagagaacataactagttagttcttcttgaaggtgatttgcgtgatcaaaataactcttctgaatttctgcaaatgtagattttctgcagggttatttttttgatctctaagtgaatattgctcaccttactttgagaaagatgagttttacttattcaacgccacgttttacacttaaaaggtggatgtgatacttattgaagtatgcttcgtgagatttgttgattaaggcgtatttataaaatagggatctgttaaaataaaggtaacttaaatgtggagatgagcctatgatttacggaacggggatcgatttaactgatattgaccgggttttcaaagtgcaatcaaaccttcccaaatttgcggaacgggttttaacagataaggaacagaacctatatcaaaaatatacgggaaaacgagctagtgaatttttggcaggtcgtttctcagcaaaagaagcatatagcaaggcttacgggacaggattgggtgctgaggttggatttcaagatgttgaaattttggataatcctgccggtaaaccaaccgtgacgaaacaaccatttacaggagttgcgcatgtttccatctcacatacggaacattatgtgatgacacaagtgattttagaagaaagaggataaattgtcttatgaacacaggaactcatcgaccaacgattattaaagtggatgcacaagcaattcgacaaaatattaaacaggaattggatcgcttgcaacctggaaatgagttatttgcggtgattaaggccaatggttatggtcacggactaactcatgcggcgcgttttgcctctgaagcgggggcgactggcttttgcgtggcaattttggatgaggcgttggagctgcgggaagccgggtttgaccaaccaattttggtattaggtattgtggagccaaaatacgcacaaattttggctgataaaaaaatctctgttgccgttggtagtcagcagtggttggaggaagcaaacaaagtgttacgcggtgattcggtggttcgtgtccattttgcattagatactggtatgggacgaattgggtttcaagaaccgagtgaattaaaagcggcggttgcctacttaagaatgcatagcgattgttttttgtttgaaggcatttttactcactttgcgactgcagatgaattggatgatcactatttcaatacacaggtggcacgttttaaagagtttatggctgttttgaccaaaaaaccgcgctatgttcatgtggccaattcagctactagtttgtggcataaggcttgtgagggtaatatgattcgatttggaattgcgttgtatggcatgaatccttcagggcacgtgcttaaagaaccctatgaattacagcctgcaatgacgttaacttctgcgctggtttttgtgaaattattgaaaaagggacgctcagttagttacggtgccacatatactgcgggggaagatgaatggatcgggacggtaccaattggatatgcagatggctatccccgccgtttgcaaggatttcatgttttagtgaatggccaattttgtgaaatagtgggacgggtttgcatggatcaattgatgattcggctgccaaaacgttatgaaatcggaaccgaagtagttttaattggtagaagtggcgataaagagatttcgatggtggatgttgcggaaaaatccggaacaattaattatgaaattgcctgtggattttcttcacgaattcctcgaagttacttgaacgatcatgaatcttaataaatttattaccatttagcacggaaacgtgatatagtaatggtaattcatgaataatgacgggagttttgatcatggaaaacattcaacagaaccaggctataactaatgacggaaaagcgacgataagccggttacaggcgtattgtgatttatttggcgttaatcaagagacagtttctgaggatgttgtggagacttattttgctgatcatcaatttgaccgcgttcaagccttgattgaggggtatgagacaatggctagtttaaacgagcaaattgtccatgaatttcaggcttgtgatgatgagtgttataacgagtttctaagaaattaataattagaggtgacaatcgcaatgagtgatgccaatattaaacgtggcgacattttttatgcggacttgtctcctgtagttgggtcggaacagggtggtatgcgccctgttttaattatccaaaacaatattggtaatcactacagtcctactgtgattgtcgcagcaattactgcgaagattcaaaaaccaaaaatgccaacccacgttggaattacagctgcagagacaggggttgaacgtaattcagttattttgctcgaacagattcgcacgattgataagcaacgccttaaagatcgtgttggggagttgaaatctggaaaaatgcttgaagttgataatgccttaaaggtaagtattggcttggctgaaaatgttcaacgtacataaagatgtttgatctattacacataggacagactaaaagggttagtgccaagcaagttggtcactagcctttttatattgagtttttggagggaaaccatgcaaattaaattagagcgtgtttatacaaagccagttgatgaatctggttatcgaattttagtagatcgtttatggccgcgaggtatttcaaaagttaacgctaagttagcttggtgggcaaaagaaataggaccaagcaccgaattgagaaaatggttcgggcatgatcctgaaaaatttagtgagtttgctgaaaaatatcgcttagaattaaaaaaagctgactttacagcagagtttattgaaaaagtacaaacagaattaaaaacacaagatgttatttttctttatggcgccaaagatgaacgccataatcaagcggttgtgcttaaaaagtatgtggaagctcaatcgaaaaaataggccatctgatagtccgcaacaaaaataccattgaggaaaaattcgtctttcaaaataccttcaatttcgaatccgtgttttttatagaactgaatggctccaggattggttcctaaagcgcgcagatgaattttgtggacaccagattcttttgcaaagtgtttgaaatgttccaacaattgtccgctaattcccacagattgctgttgaggggaaatgccaattccaaaagtccaagtatattttgaagcttccttagaggtagccgggtgaaaatcgattgcacccactggtagatcattgaggacagcgacaatggtgtcctgactggaatggtcttcaaggtaagcctgagcgtctggataggagacgtttgcaggtgtgttatttgaatcccaaatttcattttccatttggtagagtgtttcggcatcggaatcacaaaatggccgaatcattagtgaatttttcataggagcctcctgaattacagatgattttatgatatcataaaaaggttcgtggttcgcaattatcccacacaaaaaaactaaggaggtatttcttatgaccaatcatcggacgaaatcctggattattaatgcaatggtagccgcattgtacattgttttatcattattagttggtattttaaatttagcttcaggagctattcaatttcggatttctgaagggctgaaccacttggtcgtctttaataaaaaatatatttggggaattacggcgggcgtattgttgtttaatgcgtttgggccaggtaattcgatccctaatgttatttttgggacgggacaaacattgttggctttgctggtggtaggctatgtcagtccccggctgccaaaaatgtggcagaagatggcgttaaatacggttttattcactgtttcgatgtgtttagtggcattagagttaaagttaacgctgaatttaccattctggtggacatactttacaactgctgtttcagaattaattatcatgaccattactgcaccaattatgtattacttggataaagtggtgcacttcaatcaacgtattgaagaaaagtaaattaacagttatttttatatggtttaactgtttaaatccacaaactaaaaacaagctgagatgaaagttactttttctcagcttgtttttaaattttcaattaaattcgatcatatgattgcaaatcttcaatttcagggacgcggaattctttacgttccaagttgtctacaattcgatctaattttttcttgcctacctctgatggtaaagtgaacaatgtacgatgaaccagctcaccaccctgagcgtctagtgacatcacactagcgattgatgtgtattttgtaatgatcttggccatagaagctaagtcgccacgttcgccgcttgaaacgactgttaagacatagctaccaacgttcacgttccaagattgtgacaacatgtccaaaagacgggcgtgggtcaaaataccatagaagtggttgttgtcatctaaaacggtgatataaggcaaatccttaattgaaaagaacacattaaaaaatgctgcgttaactgaaataaacttggtggcattttttaataaagttgtcacaggaaggctcatatcgccaccccgagacttatgacgataaatatgcattttgtaaatatttccgcggaataactgaccagtttcatctaaaataggtacacaacgaaagccagaatcctcaagaatttttagtgcttcttccaaagtagcgtcttcacgcacggtggttaaacgttcctttggtttaacaagtgattttaagagcatatagcatccctccaactgaataagtagtcttcacaagcttaatgatagcatgttttcaaaaagagtgcgatagaataacgagacttctcactattttatcacacttttttaatgtttggttgagaagcaactagaaaacgataactggtgttcccaatgctacgagtttgtaaacctttggcatcacagatggtggcgtattaatgcatccatttgaaccgtgcgtcttgtaccaagtaccaccaaacgttggttgccaggaagcatcatgaattccaatcccagtgtcatcgattggcatccagtagctaaccttagtagcatatttggttccatctaattctgatccctttaaagttgcgttacgtttctttgcccaaacggaccaaacgccggttgttgttgtttgtttgggtggtaagccagtaacgacgtttgtcttaagctttaatttgccgttgacatagataaacatcttttggttctttttatcgacttcaacatacgtattgccaataacttgtttcttcgtattgtagcccgttccttgaacaattggttgccgtgtaaaatctttcccctttaggatttctgcagtaagggccgccgtttcatcatcgacttttaagctccatccataaaatccaccacttaccgtaacagttccacgtaatgtactcttgaatgtcttctttttgccataggtccggtacttggtattaattttcgaaacgtaagctttaactaaagttgagcttaaactgagctgaccatttttgtaagtgagccattttgcaatttcactttttggaattgcaaatttataaccaccgacattatagtttgctttttcatttataatggcattcgttttttttgcgattttagcatctgaaccagttgtgactgacgcataaacggctttggcaatcgggagagtagttgcaccagaggctaaagctttttttagtttggaggctagtttagcggcataaattttgtttccttgcgttccattacttaatttgacttgaccatttgtaatggtcaaagtgccgttcttacccgctgttcgagtcttatttaatttagtgacttcttgattgaccaactttgtgaattgttttgaattctgagttgtggttaatttagtggttgagctggcctgcacaacatgcgctaaatgaagtggccatgaccaaactgactgtttgtttaaagtagtttttaaggccgtggttgatttcaacttcaaaccgacttgttttgtattgaagcttgttagagttttaccattttgggtaatggagaatttacgattggtcagctgatttgtgatggtagtggatgcttgttgcaccgttttattacccacatttattcccgccaccttagtgttaggcaaaaagcgattgttggtagcaaagtaataactgccgatcccataaacaacggcgataagcacgatgaaaatgctaagtactcgccaattgcttttagatttgtgtctcattttgttcctcctaaattgtgttcatgtattaattgtataattcaagatactgcaaaaggaaagaaacttcaatataagaattatatgataggtaaaactaagcaaacaaaaaaaacaacaattcacatcatggaaattcgcgaattgttgtttttcaattactcagaagtaattattacctttacttctctaagttagctaaaccgtctgtcaaaacttgttttaaagtttttgcagaagcagccatcttttgtttttcgtcagcattcaatggtgattcgatgacacgtaccaaacctgaaccattgataacagctggtgtaccgatgtaaatgtcttttaaaccgtcatattggccgtccatgtaagcaccaacagggagaacagcattttcatcacgtaagattgctttagaaatccgagtcaaggcagttgcaacaccatagaatgttgcgcccttcttgttgatgatttcgtaagctttgttacgaacgtcatcttcaatcttagcaagatcatcagctgaaacgccttcttctttagcaatttcaagtaatggttttgtaccaattgtagctgctgaataaccagcaaattctgaatcaccatgttcgcccaagatgtaagcatcaacagaagcaggtgaaacgttgaatttcttaccaagtgccacacgtaaacgagcagtatccaatgaaattcctgaaccgataaccttttccttagggaaacctgagaatttccatgttgcgtaagtcaaaatgtcaactgggttagcagcaactaagaagataccgttgaagcctgagtcaacaactggtttaacgattgttgataagatcttcaagttcttgttcacgaggtctaaacgagtttcaccaggtttttgaggagcgccggctgtaataacaactaagtcagcatccttgcaatctgaatattcaccagaatagatcttctttggtgaagtaaatggagttgcgtcttcaaggtcaagtgcgtctccttgagtacgttccttgataacatcaacaacaacaaattcctcagcaattccttgttgagccattgcaaatgcaaaacttgaacctacagcgccatcgccgactaaaacaactttttgatgatttggtgtattagacaaaatataacatcctttcaatttgtgatttcagctacaagtataacacgttacccattggtttcgcattcactaattaaacttttcacaaaattaaatttagtcggtttcactaattattttttcagtgtgtttgaggttacaaaactgcaagccataagtgaatatgctacaattgattaatcaatcaaacggagtgctgaacggattatttctgttcggctattttgtatttttgccacaaattggaaagaaattaggagagtttagataaacatgaaaatgatcgttggattagggaatattggtacacagtatgacgaaacaagacataatactggttttatggttgtggatcgactagcaggtctatatcacacaacattttctaaacaccaaatggaagcaagtttggcaaccacacagattaatggtgaaaaggttttgttggtaaaaccttccacctatatgaatgaatctggccgggcggttcgtcctttgatggattattacaaaattgacattaaagatttgatcgtggtttatgacgatatggatttaccagttggtaaaattcgttttcgtcaaaagggtgctgctggtggacacaacggcataaaaagtttaattgcccatttaaagactcaagactttgaccgcttaaaagttggaacagatcatccccaaaagacaacggtggttaattacgtattgagtaaattcacggccacacaacaacctttgtttgatgaaagtgttgaccaagctatcaaaggtcttgaagactgggttcacggaatgacaattgcagatttgatgaataagtataattagaaaatcagaaaggagatccataatggagattcaggatttctttgcccaaagcgatgggattcaacaagttttaaaagaagctcaaccgaaaaaacggcaattggttaccggccttgttggatctgcaagaacccttttattaagtgagttgcttaaaaagaagcaggttcctattttaacagtttcagataatctttatcatgcccaacaacttagtgatgatttacaaaatgttcttgatgacacccagatctatctctttcctgctgaagagacacttgcggcttcagctgccacaagttctccaatttatcgaggtcaacggactgagtttttacaagcacttttgagtaataaaccaggagtgtatgtgacttccgtatccgggattcgccgtttcttaccaccaaaaaaagtgatgaaacaggccgtggtggatgtgaaggttggggcggaatttgagcttacccaattggaagatcaattaattgatatgggctatgtgcgcgaagaaatggtggctcgcccaggagactttgctgttcgggggtcaattgttgatatttatccgcttgacacggaatacccagttcgaattgacttttttgatactgaggttgactcgttaagatattttgatgctgagaatcaacgcagtgtagaaaatattgatgaaagtcttattttgccggccacagactttattgtgactagagacatgctacaaaaggggatccaggtttttcaaaaggccgttgaaaaagaaaaaaaacatttaaaaagtgataatgatttacaattattgacagaaaaatccactgatattcttgatcgttggcaacaacgggatgttcggcctgatgatattgtgtttacggattatttatatgacaggaaaagtacgttgttagattatatggctaattctggtgtactggtgatggatgattattcacggattctagaagccgaaaatgatttgcaagatgatgaagccgagtgggttgctgataaacttaaaactcatgaagtaatttcaacacaaaagtttggttttgagattcgaacgttaattaaagaaaatgaccaagcacaaattttgttatctctatttcaaaagggacttggtcgtctgaaactagataaattaacggatcttcgtacccgtgccatgcaagaattctttggtcaaatgccagtgctaaaaacggagatggatcgatggcacaaacaacagcaaaccgttgttgttctgattcaaaaaaaggatcggttagacaaagttaacgaaacactgagagactttgaaattgacgcagtggttgctcatggaaagacgattcatgcccaaaccgtgaccatcatgcaaggtgaattagcaagcggttttgaattcccagacgccagcttggtgattgtaactgagcatgaattgtttgcaaaaattcccaaaaaacgacctaaacggcaaaaaatggaaaatgcgcaacgtctaaagagttacaccgaactaaaaccaggagattatgttgttcacgtgaatcatggaattgggcgctatacagggatgaccacgctattggttgatggggtgcatcaggattacattaccatccagtattcgggaagtggtaaactttttattcctgtgacccagttaaacttagtacaaaagtacgtagcgtctgagggcaaaaaccctcacttaaataaattaggtggcagtgactgggcgaaaactaaacgtcgagttgctgcaaagattgaagacattgcggatgagttggtagaactttatgcgcaacgagaggcagaaactggatatgcgtttttacctgacgatgactatcaacatcagtttgaagacgattttgcctatacagaaacaccggatcaattgcgcagtgtaacagaaattaaacgtgatatggaacgcgcgaaaccaatggatcggttgttagtaggagatgtgggttatggtaagacggaagtagccctacgtgcagcttttaaagcaatcgaatcaggaaaacaggtggcttttttagtgccaacaacaattttggcacagcaacattatgaaacaatgattaaccggtttagtggttatccaatttctgctggtgtgctttctcggttccgaaccaaaggccaaatcaaggaaacattgacaggtttgaaaaatggtacggttgatattgtggttggcacacatcgattactgtcaaaagatgtgaagtttcaggatttaggcttgctaattattgatgaagagcaacgatttggtgtgaaacataaggaacgaattaaacatctgaaatcagacgtggatgttttaacgttgactgcaaccccgattcctcggaccttgaacatgtctatgattggagtacgtgatctttctgtgatcgaaacaccgccaaccaatcggtatcccattcaaacctatgttatggaggaaaacgccggtgcgattcgggatggcattcatcgcgaaatgcaacggggtggtcaagtcttttatttgcataatcgggttgaagatatcgaagaaacggtaagtcagattgaagcgctggtacctgaagcaagtgtgacttatattcatggccagatgtctgaaaaacaaatggaagacgttttgtatgattttgtgcagggcgaatatgatgtattggtaaccaccacaattattgaaactggtgtcgatatccctaatgtaaatacgctatttgtggaaaatgcggatcacatgggattgtcgcagctatatcaattacgtggtcgaattggacgcagtagtcgagtggcctatgcttatttcacttacaaacccaataaagttttgactgaggttagtgaaaaacggttggaggccattaaggatttcacggaattaggttcaggatttaagattgctatgcgagatttgtcaattcgtggtgccggtaatttattaggcaagcaacaacatggatttattgattctgtcggttatgatttatatacgcagatgttatctgatgcggtcgccaaaaagcagggtaaatcagcgaaggttaagacggacgcagaggttgagcttggcattgaggcttatttgccaagtgattatattgaagatcaacgacaaaaaattgagctttataaacgcattcgccaaattgaaagtcaagatcagtttgtggaaattcaagaggacttgattgaccggtttggagaatatccaattgaagtaaccaacttattggcggttggtcagattaaaatgttggctgatgaagccttgatcgaaaaaatccagcgccaaaaagacgatatatttgtgacactttccgcgcgagctacgcaaaaacttcagcaggcagatatctttgaggctttgtcggccacccaattacgagctatggtaaacattgataatggtaagatgcagattaaactggttattcagcctgcaatgaaagaaaaagattggttaaaacaattacaacagtttgtagaagctttaataaaaaagtggcgtaaatttaggagggaactcccgtgcaaaataaaaaaatgaagactgttatgcaaggagcgtttatcctaacgattgcgtcattagtggcgaaggttcttagcgctatttatcgaattccgctgcaaaacttagttggcaatactggtttttatgtctatcaacaaatttatcccatttacggaattggaatcacctttgcattgagcggttttccagtttttatttcaaaattgattgcagaacaagattcagaagctcagaaagttaaagtggctcgccaatcttttttaattttaggtctgatttcccttgcccttgtggtatttttgttaattggagcacctgagattgcccatggaatgggagattccgggttaacgccaattatcagatgtgtatcgttcatgtttgtttttatgccttttttagcggttggtcggggatactaccaaggtgtttttcagatggtacctactgctcgttcgcaaattatggaacaggttgtgcgggtagctgtcattattggtgttgcctatacagcggcacatcaaaattgggatgtctacaaaatgggcacttgggcaatgtcaggtgccgtgattgcggcagttgttagtacgctatactttttaagacttttccgtgtgaaaatttttgcgccaatacaaggcttgtcaagacagccacttatttccggaagttatggaaaattgactaaacgttttttcgtggaaggtggcacgatttgcctgtttgcggcaatcatcattttattacagctgattgattcattttctgtaaaaaatggattggtcgcgcaaggtttatctaatggtgcagctaagtcgttaaaaggggtgtatgatcgagctcaaccgcttgttcagcttggcttagtcattgcaacctcgttttcaacgaccttattaccatcgctaaccaaggcggtgcaaaaccgcaatcaatatgattttaaacggactgctcaatcgatgtttcatatttgtttagctatttctactgcggcaactgtaggaatggtgacgttattgccacaaatcaatcagattttgttcggcaatactgaaggcacaatggctattcagatttacgttgtggctgttattttggcctcactaattgcgacttataatagtgttttgcagagcctaaatatttttcggcctgccatctttgcctttacaattggcttggttgtcaaacttgccttaaatcaaacggcagtcgtgaagtatggaattgacggtgctagttgggttaccgtgttgagtttagccgttatattgggatgtatgcaagtaagaattcccgcctatttaaaaggtaaattgcatcttggatggcaattctttggtaaactgacagttgcaagcctagtgatggttgttagtgttacgttaatgcgttgggggttgttaagcctattgccagatctcaatcgaattggattgagtttagtggttatcgtgattgttttggtaggaattttggtgttcgcgacgatgtcaattgaattacgattgttcaccataagggagtggctgacgattccgtatggtaagaaactgttaaagaaattaattaagtaggtttataaataaaagaaatgaggaaaaataaatgcgattggacaaatttttaaaggtgtcaagaattattaaacgtcgctctgttgcaaaggaaattgcggatcaaggaagaatcttgattaatgatcgtactgctaaatcgtcaactgatgtttcagtaaatgatcaaatcgtgattaaatttggtaataaaacattaacgattcgggtagacgctttgttagaaacaaccaagaaggatgatgcagagcggatgtacaccattttatctgaagattacgcacaagattttcgaaaatagatttctggttttgttataaccaaagacagatcagtactagtttattttgggactggatttccactttgtgggagtttagtcccttttttagtagttaggaaaccacttacaaaatttaatgaattctttccaacaaatccatagacactgatataagagcttgttataattgcctttagagatgtttaaaatttggggacgggggttgtgtaaatggcaagtaacgtgaacgggtcacagcgtaatttaaccaaagcaaacgaaaaaatcagaaaaattcgtacaactcgactgcaccgtttttatatcattatgggaattttcattgtatttgttggtatttttggctttcaaattatccacactcactatcaacgagcggctgtggatcaacaaattcagaccagtaaatcacattattctgcggcaaaagcagaaaataagacgctaggtttgcaagtgaaacaattaaatgattccaattacttacaaaaattgttgagagaaaaatactattatagtaaatcgggtgaaataatttacagtttaccttcggatcattcatccgatgtcagtcaaaattaattgaattttttagaagtggttatctttttcgagtgcgtattctcacggaaaagatgatcactttttgtttaaaaattcgtttaggatatactcgcacttgcattcatgtggtgctatacttgttacacatagtctaaggaggaagtacttttttatggcaattgaagttgggtcaaaggtatctggcaaggtttcgggaattactaattttggtgcgtttattgatttaggcgatcacaaaaccggattggttcacattagtgaagtttccaatggatttgtgaaagatattcatgatgttttaaaggtcggcgatacagtcaccgttaaagtactaacagttggcgatgatggcaagattggtttgtcaattcgtaaagctgaggaacaaccagctccagcgcatcataatcataaccaaagtagtcattcaaatcatttcgaacatgaggctagttcacatcgttcttcaaagccaagttctcattatcaaggccattcaaacaagcaacatgacgatcccaaagattttgactctttgttatcaggctttttgaaagatagtgaagtccggttaacaactttgaaacgtaatactgaaggcaaacgcggaggtcgcggaggtcgtcgaagttaattaaataaaataaagtgagaagcccgttacaaaacaaacgttttggtcgggcttttcttcaaattagaaggtgaaatttaatggccatccaattacaaaaagcttttgatttaatcatcaggcagtatcatgtaaagccaacggattcagttgttgtgggcgtttcaactggggttgattctatggtgttattaacattgttagaaaagttaccggtaagctgccgaccaaaaataattgtggcccatgtgaatcataaattaagggaacagagtacagaagaacagacctttattgaagcctatgcacgtaaacacaacttacaattgagaattaaagtttggccattaagtcaacatccggacacggggattgaaaacgcggctcgaaaggtgcgttatgatttttttgcagaagtcgcgcaaaacctgcaagctcgttttttgttcactgctcatcaagcggacgatcaagctgaaacctttctaatgaaattagttcggggtggcgcactacagcaattacaggggattggttcgagagacttaactaagacaacgaaaatcgtacggccactattatctttttcaaaagaagaaattcgtgattttgcaacgtctagacatttgaagtggtatgaagaccaaaccaatacagatgaaagcttcacgagaaatcgaatgcgccatgagattgttccccggcttaagcaagaaaatccgcaatttctgaaacatgttcaaagctatgaatctcagttacagacgttaatattggccacacggcagtatgaagaaaagattgtcaagaatctactaattgatgaagggtacaaagttccagagtttttattattaagtgtggaatggcagagcttagctttagagttcattagtaataaagaagtgggcaaaggattagtttctaaaaaacaacagacagaaattctacaacttcttggtaatttgaaaaaaccatcggggaaaattcaaattaattcacagatgtggtttgtgaaagcatacgacaaatttagttttcaattggtttcaaaaatccataaaaagacgctgataacgcggaattctatgttaatattgaatcaatggcatttgattgaaagctttggtcaggttgctgtatttgaagctgacaaatactcaggtaaggtgactgatttgcaacaaacaatgcagcttagtcaaaaccaatttagcatgccactttctgtgcgcccggctaataggcaagatcagttaagattgaaaactggtggtcataaaaaggtacaacgtgttttaatggatgccaaggtttctaattggcaaagaaaagggtggccattgctggtagacgggaatgggaaaccaatttggttattaggccttcgtaaaagttggcttgagaaaacgtttaaggtagaagaatctaagtatttcataatctggaaacccaataatctggaggaatcaaattgatgaacgatgatattgaacgtgttttatatagtcaaaccgacattgctgatgcctgtgcacggttaggcaaacaattatcaggtgactacgaaggtaaagttcctgtagtcttgagtgtgttatctggagcagtatttttcacaactgacgtcatgcgacaaatgaatacatacactcagttagattttattgacgtttctagttatcatggtggtacaaagtctagtggtgaagttcaattggtgacggatattagtcgagacgtaagtggccgtgatgtgcttattattgaagatatcgtggatacaggtcgaactctcaaatttattattgatcttttgaaagatcgccatgcaaaaagtgtgaaagtctgcactttattggataaaccaaccggtcgtgtgttggaagctaaggcagattatgtgggatttgtagtccctaatgaatttgtggttgggtatggcttggattataaaggtgagtatcgtaacttgccatacgtcggtgttttgaagcccaaaatttatatggataaataattggtcaaaattggtcaagtgtgatattatctatctatcgaaggctaagcacacgtttgctcaccgttcgtaaaaccatcaacaaggaggattccaatgaataaaaaagggaataacaacggacttgttaaaaatagtttgttttacatcgttgttttcttagctttggtgggcattatttattttgtcaccggtcaaggaagcagtacacaaacggcatctatttcttcaagccaatttgtgtcccaattacaaaaaaacaaggttaagagttttgtcgtacagccaactaatggtgtttacaagattactggtaaataccgtacagcgcaaaaaggcagtgctcaatctggtttattcccggcgtcaacttcaactactaaagttgaaagctttacaacatctgttttgcagaatgattcaacaactgcacagatcacgaaagctgcgcaaaaggaaaatgtcaaaatggacacaaaaccagaagcttctaacagtttctgggtacaattattaattactggtttaccactgttaattttcatcgtcttcttctacatgatgatgagccaagcaggtcaaggtggcggtggtagtaagggtgtaatgaactttggtaagtcgaaagtcaagccggccgataaaaaggctaataaagttcgtttctctgatgttgcgggtgaagaggaagaaaaacaagagcttgttgaagttgttgaatttttgaaagatcctcgaaagttcgtgtcattgggtgctcgtattccatctggtgtgcttttagaggggcctcctggtactggtaaaacattgttggcaaaagcggtagccggtgaagcaggggttcctttctactccatttctggttccgatttcgttgaaatgtttgttggtgttggggctagtcgtgtgcgtgatttgttcgatcaagccaagaagaattcaccttctatcattttcattgatgaaattgatgctgttggtcgacgtcgtggaagcggcgttggtggcggtcatgatgaacgtgagcaaactttgaaccagttactggttgaaatggatggatttacagggaacgaaggcgtcattgttatggcggctactaaccgttctgatgttttggatccagctctccttcggccaggtcgatttgatcgtaagattttggttggtcgtcctgatgttcgtggtcgtgaagctattctgaaagttcatgctaagaacaaaccacttgataaaaatgttgatttgaatgagattgccaaacaaactccagggtttgtgggtgctgatcttgaaaacttgttaaatgaagctgctttacttgcggcaagacgtaacaaaaagattattgatgcttcagatttggacgaagctgaggatcgagttattgcgggacctgctaaaaagaatgcagttgtcagtcctgaggaacgtaaggttgtggcttatcatgaggcgggccatacaattgttggccttgttttgaatgatgcccgtgtggttcataaggttaccattgtacctcgtggtcgtgctggcggttatgccatcatgcttcctcgtgaggaccaaaacttaatgtctaagaaagatgctatggaacagattgccggtttaatgggtggtcgtgctgctgaagaaacaatctttgattctcaatcgtcaggtgcttccaatgactttgaacaagccactggaattgctcgtgctatggttactcagtacgggatgagcgataaaattggtcaggttgaattatcagctccaggtcagtcatactatggtgaaaatgggccagcatattctgaaaagacggccgcaaccattgatgatgagatccgtcgtttgactgaagaaggtcatcaaaaagcactggatattattgctgctcaccgtgaacaacacaagattattgctgaagctttgttgaaatatgagacattggatgaaaagcagattttgagtttgtataaaacgggagaaatgccttctaaggatggtgcttcagaatttccaagcgaaaaagcggcaacgtttgaagaatctaaacgtgagttggaacgtaaggaagctgaacgccatgctgatgataatgatggcgatactagtgattcggactctaaattagaagctcctagtgaacatgatgaagattctactagcaatactggtagcaatcatcgtttaccaagttcacatgatgattcgagcgattcacaagatcatgattctaatgatcatacgaatttgtaaaattgaatctgaaataaaggtttataaaaacagcaaatttagtaaggaacttccttattggtttgctgtttttgagtagttaggggttggtttcgattacaagatgtgtgaaaatgtaagacggtaaaagaaaacttgaggagaaaacatgaaagattatttaattaaaagtattattaatgatggcatgtttcgtgcttatgtggtgaacggtacaaacttggttaaagaagcgcagaaacgccacgatacatggagtgcagcgacggcagcattgggacgttctttagttggtacggtaatgcttgcatcttcgttgttgaaaggtaaagaaaaattaacggttaaaattaatggtggtggcccagtcggggggattgtggttgacggtaatgcgaatgggacagttaaaggttatttgaagaacccacatgtttcattgcctttgaatagtaaacatcatattgatgttggtaaggctgttggtaatcagggaacgttttcagttactaaggatatgggattaaaagatccgttcacgggaaatgtgggattggcatccggagaaattggggacgactttacttattatttagcgcaatccgaacaaattccttcttcagtgggtgtttcagtatttgtcaaccctgatgaaacggttgaagtagccggcggtttcatgattcaagtgatgcctggagcgagtgacgaagcaatcgatcgtttgcaaactactttgaatgatctaccattagtttctgatttattacggcaaaaaaagacaccagaggacattttgaaacttctgtttaaagatgataaagtgaaaattttagataagatgccagtttcatttgaatgtgattgttcaaaggatcgttttgcggcggccatgtcgagtttaccatctgacgaaattaaaacgatgattaaagaagatcatggtgctgaggtcacttgtcggttttgtgggaataagtatcattacagtgaagttgaactaaaagctattttacttaagtcacaaagctaatttttatttgggtgactatcagttatgtgctattataaatttcatgactgacttttagtaagataattggcaatgatcaagataaaagctaaagtggatttatcaaatatgtagatgaggtgacaaaatggaatggcaaattggcgatgttaagattcctaaccaactagtcgtggcccctatggctggtgttacaaattcagcttttcggttgatttgtaaaaagtttggtgcaggccttgtagtttgcgagatgatctctgatcgtggaatcatgtacaaaaataaaaaaacattaagtatgatgaatgtggatcctcatgaacatccaatgagtattcaaatttttggcggtactaaagagaccttagtggaggccgctaaatttgtggatcagcatacagctgcagatataattgatatcaacatgggctgtccagttaacaaagttgtgaaaactgaagcaggcgcacgttggttgttagatccaaataaagtttatgaaatggtttcttatgtgacagatgcggttaaaaaaccggtcactgtgaaaatgcggacaggatgggattctgatcatatttatgcggttgagaatgctttggctgccgaacgagctggcgcttcagctttggcgatgcatggtagaacccggaaacaaatgtatacgggtcatgcggattgggatattttgaaacaagtttctgatcaattaactattccatttatgggtaatggtgatgttaaaacagctgaggatgccaaacgaatgctggatgaagttgggtctacagctgtgatgattggtcgcgcagttttgggtaatccttggatgttgcaccgtgtttctgcttatcttaaaactggcgagttaatcgatgagccgcaaccagcagaaaagattcgagttgcaaaggaacatttacatggcttggtggaactaaagggtgactatgttggtccgagagagttcagaacgcaagcagcgtattatctgaagggaatttctcattcggcgagaactaaggtagcacttaacaatgcagagtccgaaaaagagatggatgacatatttgatcgctttgcagagcaacaacaagagcgggcaattaaacgtcaacaaatggcaaggtaatcggtacttgcttttttagtgtaaaataggcatcatggatacgtgagactaatggtagaggaggattttttcagtggcacaaaaagagcaagacatgaacgatcaattgaaagttcgtcgtcaaaaaatgcaggatttaagagataaagggattgatccgtttggacatgcgtttaaacgcacacatctaactaatcaattgcatgaacaatatggtgagctttcaaaagaagaattagaagaaaaggatgttaaggcaaccattgcaggccgcatgatgtctaaacgtggaaaaggtaaggttggttttgcagatcttaaggatcgtaaggggaccatgcagatttatgttcgtaaagatactgttggcgaagatgaatatgccctttttaaacaagctgatattggcgactttattggtattactggtgaagtaatgaaaactgatatgggtgagttgacagttaaagcaactgatttaactttcttaactaaggcgcttcgtccgcttccagataagtatcatggtttacaaaacgttgaacaaatttatcgtcaacgttatttagacttaatttcaaatgatgatagttttgaccgcttcatgaagagaaccaagattatcagtgcagttcgtaagtatttagatggtttggactatacagaagttgaaaccccagtactccactctcaggctggtggtgctaatgcgcgaccatttattactcatcacaatgcgttggatattgatttgtatcttcggattgcgttggaattacatttgaaacgtctgatcgttggtggcatggaacgcgtttatgaaattggtcgtgttttccgaaatgaaggaatggacacgcgtcataatcctgagtttacaatgcttgaaacttatactgcttattttgattttcatgatgtgatggatgaaactgaaggcatttttaaggcagctgttaaagcagtttcaccagatggtaagatcacatttcaaggaactgatcttgatttaggtcaggattttgctcgtatgcacatggtagatgcaattaagaagtataccggtgtagacttttggccaaagatgagtttggaagatgcgcggaagttagctgatgaacataaaattcattatgaagattggtggcaagtaggccatattatcaatgaattctttgaacaattagttcaggataagttaacccaacctgtatttatctacggtcatcctgtggaaatttcaccattggcaaagaaaaatcctgatgatgaacggtttacagaccgatttgagctttacattaaaggcaatgagtttgctaatgcttttactgagctaaatgatccaattgatcaacgtcaacgttttgaggcacaagttaaagaacgtgaacagggtaacgatgaagctgaaggcattgacgaagactttatcgaagctttggaatacgggatgccaccaacaggcggtttgggtattggaattgatcgattagttatgctattaactgatgcgccatcaattcgagatgtgcttttattcccaacaatgcgtccagataaatagaatagagccatttaaacaaactattgcaatttttttgcaaatagtttgtttttttattttactatttataatatttgaaagctgataatttaatgacaggtttgcttaaaatggaaacaagatgttgtggtgaatacaaattgttcggatctgtgtgagtttgtttaatgaattttggctctgaactcgagaaggtcgaattttggtgttgaccaatcgggtattttttggttatactagtacacgttgtttagaaagacatcatgtccaacaaaacttgtcaaaaaagtttttgttgacgaacttaattcaaaatgctattattatatagctgtcgaaaattgaatttatcttttggaacagcctaacaataaaaggctgtcggcaaaatcctcattttgcggcagcccatccctgaagagttgattatttattttgacgagccagttccaaatagcgttcgtaccaaatggcgataaattctttggaaaagggtcccttctcattttcaatccaatcaacgagaatgcggacattgcgttttaagatgtgatcaatctctgggccataattccaacgcttactgaaggccaaatattcatcggcatccagtaatttgcgccggccgtctggaaagactttgacgtccaaatcataatcaatatattttaaagcttctttatccaaaacataaggtgatgccagattgcaatagtaagcaatcccatcatctcgaatcattgccaccacgttgaaccagtaatgcttatgaaaatagaccagcgccggttctcgagtgacccaatggcgaccatcgtcctcagtcaccagggtatggttgttacatccaatcaacgaattctcactcgtctttagtaccatcgtatcccgccaaacgcgatgcaggctaccatcatgcttgtagctttgaatcgcaataaactgaccttctccaggtaatttttgaagtcgtggcatgtatggtacccactttctgactaacctaaaagcatcgattgttcccaatccatttttcattatatcagagtgggcattattttcgaaattattttattcagtcagcttcgccagggcaattgtgatgtcatccatcaaaaagcctttccggaaaagtgcctgttttactttttgattgcgttcatagggctgaagtttgcgatactggcgccaatacttttctgcgacttgatcaataaccgcttgatcctttgttgccatgtcggaagtatcgacttgattcataatctcctcaatatcaccataagggaacccccgacgcatcaaaagctccttggtcttgttgatggccattttggcagaatcgcggcgatagcgtttcaactgtttttcggcaacttcaccgccaatttcaatgacctcttgagccggataatattggttcagcgaattttctgcctggtcggaagcaacgtgtttgtctttcaaatgacgccgaatccaatccgggccatttttgcgttcacggaccaccgtccgaacaaagctgtctgcgtatcgttgatcgtcaattaaggtttgatcagccaggatatcaatgacttgatcgatggcgtcctcgtcttcagtcagctcagcgagcttttgtctgacttcgtactcggttcgcaggttgtgagcgagataattcagcgcccggctgtgaagtttggaaatgttatcggcatttttcagggtttcgattaattgatcgtccagttccattcccttgaaaacccgatatttgatgaagacttcttcactgattggaaaggcgtattgaccgtccacatagacgttgaagcggcctttacgtttctgggcttcaattttagtaattgtttttgccataagcgtcctttcttttctgcgtgattgaaattcactttgtcattttgatttggtatactgagaacaatttaagatagaggatgaaaaatatgattactgctcatgtagtttacgcaacaattaccggcaacaatgaagatattgccgacatcgtgactgaagcattggaagatgcggatgttcaagtcgaagaaaccgaaatttctcaaactgacccgtccgtttttgaaaacgtcgatatttgtgttgtctgcccttacacctatgatgagggggctttgcccgaagaaggaatggacttttacgatgatctctccgacctcgatctaaagggtaagatctttggggtcgcaggttcaggggacgttttttatgaggaattttacaacacatcggttgataaattcgaagaggcgtttgaaaagactggggctaccaaaggcgcagagagtgtcaagattaatttggaacccgaccaaaaagatatcgaaaagttggatcagtttaccgccgaactggttgccaaagtcaatcaataaccagtcggttgaatcatcaatgggggaggctgagacaaaagtatacgcttttgcctcggcctctatttcttgtgatcccatattatttatcaacaacgtgcgacgacggccagcatgcttgcctagcctacatggcaatcggctgatcccggccatttaagagcacagatcaatcattccaaaaccaggaataaccgatctgtgcgcttaaattctgggatcaaaacgcctttagtcccactctctcctttttggttgtcaagattacctgcccaccttcatttatgtttcctgatcttgcgggcccgtttccaaacattttcaatggcgtcttcctgctcctgaattttgccctggcgaatttcttgaatcgtggcattgaccaccccgccaaacagcatgatgaccccggagaagtccagccagaacattaagacaatgaaagttccgattgtcttataagcatcgattctctgagagaagaatttcagataaacggtgaaggcttgggccaacagcatcaaccccaaggtggcgatcaaagcaccgacccagacatagcggaatttaactttggcagtcgggacaaaataaaacagcagacttaacagcagccaggaaacggcaattgttcctggccatttaacggtactgatcaggttcaatatccatcccgggacgttcaaaatcggcgttaaccattgaaaaaacatctgaccaaacgcaaaaaccatcatcaagacaaccagtgcgagaaccaacaccagcatccaaacgaaggaaatcagccgatttgagatcgctgtttggtcggcagcaacgccgtacgttttattgatactgcgctgaaaagccgcaatcgcccggctggctgaccaaatggtcacaattaaaccaactgataattggctggcacccccactttgcaaggtcgaattgatgatcggttccagcatggaatagattcgatcaggaaacagcggtcgcagatagacttcaacttcggtgatatgaatatgaaataagttcaaaatactgccgacaatgaagaaaattggaaaaatcgacagcaacgtatagaacgctaacacagcggcagaatcggaaacgtctccggatgaatagcgtttaataatgatttcgataaagtttttaacggcttcgtataatcgtttcatcaggcatcgacttcccgcaattattagttgaactggtctcggatcgcttttaggattcgttcggcggcatgaccatccccgtatgggttcttggcttcagccattttctggtattctttgggatcgtcaagcaggcgctccatctctgacttaacaactttgggatcggttccaaccaaccgcaaggtcccagcctgaataccctcgggtcgttccgtggtgtctcgaaggaccaacaccggtttcttaagcgacggggcttcttcctgcacaccaccggaatcggtcataataaagtaactccgagcggacatgttatggaagtccaaaacatccaacggttcaatcaaatgaactgccttgacgccgtcaaagacttcatgagccactttttgtaccgctgggcttaggtgaaccggataaaccacttcgacgtctggatggttcgccaagacttctttaatggcttcaaacgttcggcgcatcggttcaccctggttttccctgcgatgcatggttaagagaatcatcttcgagttttccttcagttcatcaaacacagaatgttggtagttttcggtcaccgtctgcttgagggcatcgatggcagtattgccggtgacaaaaatattttgatccggatgattttctttaagtaaattatcccgacttaatgacgtgggtgcaaaatataagtctgccaacacatcggtcaattgccggttcatttcttcaggatacggtgagagcttgttccaagtacgcagcccggcctccacgtggccaattttaatttggtgataaaaggcactgatactggcagagaaggtcgtggtggtatcgccatggaccaagataatatcaggctgggccttttcaataatcggatccagttcggtaatgacccgggtggtaatgtcgctcaaggactggccctgtttcataatgtttaaatcatagtccggcgtgatatgaaatacatccagcacctgatcgagcatctctcggtgttgtgcggacacaaccgtaatgggttggaattcgtctaaatgctgctgcatcagtaggataatcggggccatcttgattgcctctggccgggtgccaaagatggtcattacttttattggtttcatcaattaattctccttttatgtggttaattatatcaaaaatggcaagaaacttaacagctacttaattttgtaaaaaatatgatatggtataatctggtagatgttcatttttacatagcgaggtgggattcccacttcggccactgatttggtctgctgctccaaacggattccagcttaccaataaaaattggcaaaagcaaagtcattaacaaacgtactggaggaaatattttgaaaacgatcagtctaattgttccttgttataatgaggagccaacggttgaacttttctacaacacgacagaaaaagtattcgataaattaaacgcgtcccatgaagagcactaccaccctgactatctgttcatcaacgacggttcggcagataaaacgctggacgtgatgcggcggcttcattcacagcacccagacgaagtccattacatttcattttcaagaaacttcggtaaagagtcggcatttgctgccggcttagccaacgcccatggcgattatgtcgctgtgatggatgtcgacctgcaggatccaccggaattattgctgcaaatggtcgatattttggaagatcctaaacaagattatgacgtcgtcggctgtgtccaaaccagccggaaacagaatcccatcagagcgtttctttcagcaagtttctacaagatcatcaacagaatgtcaaaggtccagatgaaacaaaacgtccgtgactaccgcttaatgagccgcaagtacgttgacgccatcttaaagctgcccgaatacaatcgctttagcaaggggcttttctcttgggttggtttcaaaaccaaataccttgagtacgaaggggttcctcgggctgccggggagacttcctggtcgattttccagttatttgaatactcgatggaagcgatcgtcgacttttcggatgtgccgttaaaattagcgacttttgtcggcatcctgaccttcttcttgtccattatcggcctgttcttcgttgtcattcgggccctgttctttggcggatccgtcaatggttgggcatcaatggtctcgattatcctgttcctaagtggtgttcaactgtttagtttaggaattttgggaacttatgtcggtaaaatttatctggaaaccaaacatcgtcctaaatttgtaattgcggagaaacgttaatatgattgatcgattgaagaagctatatgataaatacgaagaactcattgcatacgctttttggggtgttgcaacaaccgtggttaatgtcgctgtctttgctgcgctccacctattcaccagttggaattacattatcaacgcatcaattgcgtggtttctcagcgttttattttcatacctcaccaataaagcttatgttttccattctccttcaaaatccttgaaaagcgattttttcgaaatggtttccttttttggtggcagaatcgcgacattgttattagaatttgtaatgctttggattggtatcacgctcatgcatcaaaatcaaatattagttaaaattactgaaaacattgtcgtaattgcgattaattatttctggtcaaaattattggtctttaatcacaaagatcagcccaagcaaggacggtgaatcagttgccaaaaattaacagacaaacgctcagacagcagcgacaagaatttcccgaaggctattacaccaaagcggacggcttcaagctgttggcaatcgccgcagtgatggttgtaattttggttgtggttgccaactatctcatgtaaaaacgatatgaaaaaggtcgaaacacaattaatctgtgtttcgacctttttttgaaccaattttttgtatcacagttatcgagccaactcccgttccaactgggtttgaccaatcgtcatcagccagcagaagaaccaataaaccactgcaatcgtgatgtaaatggtcatgtaatcctgattggcaccggcaacaatctgagcgtccataaacatttcactgactgtaatcatcgccgccagcgaagtccctttgaacagatccagcaaaatatttcccaacgccggaatcgcaattcgaaaagcttgtgggaaaacaatcttggaaatgacttttcggtatggtaagcccagcgagtaagctgcctcccactgaccgtgatcaaccgcactaaacgatgaacgatacacctcggacacaaaggcactacagttgatcgtaaaagcaatcaccgcggccggcaatgcatcggctcgaaagccaaagtaaataatgaacagcaagaccagcatcggcactccgcgcataaaggaaataaatgcccgcgcgggatagtgcaacaatttgtggtgacttaattgggccagcgttaagaacaatcccagtattaatgacaaaataaaactgatcgcggttaatccaatcgacatcggaaagcccgctaaaattctgggaattgaacgaaacgctaatggtgcgttaaaaaaatccggaattgataaatacttaataatatccaacagcaccgccccttacttaatcgtaaaggtctttgaaatgtggacatggggctgtttagtaacgtcagcgtgataatacttctctgacagcttcttcaaagtaccgtctttcttgagctctttgagggctttgttgacctgcttttggagcttggtattgcccttcttcatcaagataccaacacctttgccatcttcattggttctaaagtacatgtttggcatgatcttcaaagtattgttgggaacggcagccaatgctaatttctgcagatagtagtcattcataatcagatcagtcttgccgctttcaacgtctcgcagatacacatcgtttgaaacgttgttgtagttgacggtcttggcgcctaactgcttggcaagtcgttgataatcggttccggcttcaccggcagcttttttgcctttaatgtcggcccaggaatgaatgcctgaatcccccttctttcgaacaataatactgttaaatgagtgcttgtaaggcgttgataaagcgaattccttctgtctttgtggtgaaacagagaagtcattagctgccatatcagccttacccgtctttacagccgtttcctgaccatcaacgttcatttctttgaaatcaacttttctccccaactttttggcaactgcacgaacaacttcgacatcaaagccggttagcttgttagtcttttgatcatgaaatgatgttggataaagcgtccccgatgtggcaactgtcaatggacccttatctgctgattttttctgaccgcagccagtaatcaccaagcccagaaccgcaaatacgcctaacaacatcaaccaacggaacttaattctgcgcataaattgtcaacctcctaaagtttttggatcattatcattataggcatgtgaaaccgatttcacaatagctgataaattaattgttaaatattataaatcccctcaatttttgataaataattgttggtcgccaaagtgatcgtcaatttagtgttggctccaaatgctttaacgtcgcatattttagccaatcagtatttagtcatattagaattgcccttgaacgacactgagattggcatataataaaaacatttgaagtgacaagcatcacttgttaatcaattcgaatggaggcttttgatggatatcagaaaagaggctgctcaggcaaattcaaaattatcaacgcttgagaaagtcagttattctttcaccgatatggctggaaacttgctctacgtcagcatgtccagttatattctttatttttatacggatgtttttgacattccggtttcagcagcgggcatgattattttgattgcctgtatcgttgatgcggtcagtgcgattttttggggatcaatcgttgaccacacgcatactaaatgggggcagagcaggccatactttttgtggcttgccgtcccttttgcgttaagcacctttttggcatttaccgcaccaaatatttcaggcgtccccaagctcttatatgccgggattacttatgtattggcggctggagtgatttacaccggcatccaaacgacgatttccgcaatcctgccaaatttaaccctcgatcccaacgaacggattggcgccaactcttaccggatggtcggcagtctgattgggtcattcgtgaacagtacctttaccctgccgctggtagcattctttggcaacggtaatgacaagcacggcttcatgatgacaattgccatctttggcgtcgcagcaattgtcctgctgatcacggcattcaagaacatgcgtgaacgggtcccggttagccaaaaatcactgccgttcaagcaaagtttaaaggcaactgtcggcaacgtcccttggtacctcctagtgatttcttttgccaccttttggatcgcccaagctgatcggaatagtttctcgacctactatgccaaatacaatctgggtaatgccgaacttgccgcggtattcagtggtttacaagttctggggatcatctcaagcatttcaattccgtttattgttaagattgccaacaaaacagcaaccatgttaatcggcttgggaattcgtgctgttggccagacaatgatggcgctggttggcggcaacttcatcttggtgatcgtttcttggtcgatcggcgttttgggatcggctctggcaatgtcaatgccatttgccatgttggcagacacggtcgactttggcgagtggaagaccggtgtgcgggcacccggcttcttaaccgctgtgggaagcgcattctgtatccagctaggatcaggctttggcagctttattccatccaaaatcttggatatgactggctttgtcgccaacaagacccagacaccagcagcttcaggtgcgattaacttttattttatctggctgccggttatcatctacgcgattgtcgccggcattatggtcttttatctcaagtatgagaagatggagccaaaaatcaaagccgatcttgtcgcgcgtgctgaacaacgtgacgcctaatcaaattgaattgatccgataaaacaagaacgtcaacgatgaacgaaatccattcatcattgacgttcttatttttagttcgtatttcgtaaaagcgatcgaatacgccatgaccccacccggactcgaaccgggatcaaccgcttaggaggcgggtgccctatccagttgtgctatggggccaaaacaactgcactacaattttctcatttatctcagaggctgtaaagagaaattatccctccgtgcgcttatggtgcatccccttgcgtttggagtgtttgtgcttctttttgccgtgcggtttggcggggattggctttcggccagtttttttagcctcactgctccgcttgacatcttgagacgatacagtctttgaagttttgggttcatcatccaaattaaccggctgcttaggtcgagtatcagacaactgattaccatcgaagtaaatgttgctcaattcatatccgtaaggcttaaccaacttctttaaatctctcaaatcgtgatcgtcacccatattgatcaccatgccgtcttgatgcatgcggccagtccggccaacccggtgaacataagttttcggatcggacggcaagtcaaaattgaccacgacgggcagcttttcaatatccatcccccgagcagcaacgtcggtggtcaataataagcgaattttgccgtcgcgaaaatcccggagcgccttttgtctggcagtttgccgctgttcactggtcaactgagcagcctctttaatgtgtcgatgagacaggaaaccagcgactttttgcagggtgtccagttggtcaaagaacactaatgccttgaagtccttcatgtgaaggaaccgcagtaacatctgtgcctttttccgattggaaacttccagcaaggtatgtttgacttccccgcgggtatcgtcaatgtcagagacatcaaaggtctgaatatcttgcacaaaccagcgattcacatgcgccaataagtcgttttgggttgcggagaaaaagcccagtgtcactgagtcgtcagccaaatccaccaaggagcggatggaagcaagcgtatcttcacttaataagttgtcggcttcgtctatcacgatcgccttcagtgaatccaatttaagtttgcctaaatcgattaagttcacgattcgaccggtcgttccgacaatcacgtttgggtgctgttttaatttatcaacttgacgattgatattggcaccaccgataatcccttgaactgataagccgatcagcttaccccattccaataaaactttttgggtctgcatagccagttcggcagatggttcgatgactaataacgacagcccgtcttcgggttgaatattttccaacagcggtaaagcaaaggcaacggtcttcccggatccggttggtgccaaccccagaacactttggccatctttaagtggttgataaaccgcttgttgaatcgcagtcggttggttgtaccctagttgcttagcatgctctttaaattcttctatcaatatggttctccattttctaatcgattactttttctcgcccacaaatgagatgtgagcatcctgtctaagattataaattaatttattgacgtacacactgagttgacgccagtaatcataatcatgtttgttttgcgggttctttggatcgttaatcactctggcaaaatcttcaacctctggcagcattggattctcatcaatggtgttgccaatgacctgcttgttgcgatcgtcatcaatgtaaatcactgcatttatttctccggcatcatcgatttcgattaagtctttgaggccgtaaatctccgatgtcatatctgagttggtgatctttgagaagtttaaagtcacattatactccggatactgcaaaattgctgttccttttccgtcaaccccggtccgaatcagctgtgagtaataagcagcctcttccggcatcccgaacaaggcaacggcatcataaacggtataaacgcccaaatcctggagagcaccgccggcatatttgagtgagaagacgttgggttcttcaccctccaacaccagatcatacctggaagagtattttgaatacgtgaattcagcgccttgaaccgttttaagttgaccgagctttttttcgatcgcatgaaaattttcggtgtgaatattgcgggcggcttcaaaatagagcacttgtggattctcgtccaacaaagcttgaatcttcgccatttgtttttgagtactaaaggccggcttttcaacaatgacatttttgccgtgttgaatggccatttgggcctgttcaaaatggaggctattgggtgaggcaatgtagaccgtctcaaactgccccttggtaaagaacgcattcagatccgtaaaggtttcttgggcgccgtttttggccgcaaaagttttggccgtttggtcgtgtcgtgaatagacactggttaagtcgaatttgcgtgatagtttaattgcgtcaataaattgctgggtaatccagttggttccaataattcctaatttaatcaatttgataaccgcccttctttaattaaattgtaacaaggttttaacccaatgaaaacgaaatcagacactctctgttatatttatcgactatactgggtttctactatgactagggggatgattttttgcgcaaaagaagtttttttatctttatggtgtcgtttttaattagtctgttccataccaaacggacaccgaaacaccggccagatcctgcagacccaatgtttttcgttgggacctggcagtttaaggaccaccgggagcgagtccatcgacttgaaatcggcccggatctaaaattactcattgacggaaaagatatgtctgccaaggtttcattattaaccagatatgaattgtcgtacgttgacaaatttggttataaattggaaattcgggggaatgaagcccggccaatcaaattctacgatgaatctgaaaactatacctatgatttacaatcggccaatgaaattgaacagtcaaattgagtgaggacttactgtggtaaggcctttttgttttggcctgctccatacgctttaattgatgtattcccgccactgtctgcgattaccgttaaagaccgacatcggcaaaaagatcagttgcgagtcaagcttaaagccggccttatcgtctgcctgaataaacgttgcatcggcattgggccggccaatcttaccgtcagtcaaccagaattgggtcttagcattcgcctttaactgcaggctcttgatgatttgttgggtcgccgaaatgaccaccggccgtttatagtactgtcttaacagttgcgaaagctgccggacttcttttctggctgcctgccaatgaattgttgactgatcaaacgttccgtaatactgaatttgaatacagatcggtaaactaccggtattgtacttgacttgccggacaaagtttttgaattgggcagttggtgaactggtaaaactaaaataatggtagaccccaatcggtaactgtgaaccttggctgcgttcgaaattactctgaaaactgtcatcggtgaaggcagctccctgagtggcctttagatagacgaaactgatgcctttacttttcaaactttcaaagtcgatatagccattactttgatcgatggtcaccccatgaattgggtattttttcagctgctgattttcgtgccagcgcaacagcaaaaaggtcgaaaagccaatcaagattaacaaaaaaatgccgaaaactaccctgcgtgtgcgtttcctgcgctggtaagtttcagcatatattggttgaatgtctcttcgcttcatataaaggtcatctcagttacccgaaaaatccagttaaattaagtccgggtactttcaataatattttgaacgttgcgaatcgcatcttctgtcgccggacccatccgaaccgttgccatcataaacaacgtatcgacaattgcgagttgggcaagcagtgaatacatcccttcagaacggtaattggattcatcactagacgaaataaatgtaatatcactatgcagtgcgagcggtgagtccggataactggtaatcccgataaccggcacctttcgcttctttaaggtttcggcaacttttaaagtttggcgatttttgcccgagtgggaaaccacgattgcgcaatcttcttcacccaattttacagcttccatcaactgtacgtcaaagtctggataatagaagcagtcaatcgacgtccgcaagaacttatgataaccgtccagggccgcaactgacgagccgccaaggccaaataagcccagacgacgacaatgaataattctgaggactgcccgagcaaattcatcttcatcaattcctgcccgggtatcttgaattgcccgctgactgctgttaaaaatcttgtcagcgatcgttcctaaagaatcgttggcatcgatatctttaaaaatcggcaggttctgcggccgtaactgcgtgtaggccagcgccaaagtaaactcacggaaattgccataacccagtgtcttcactaaccgagaaaccgaagcggttgaggtttcagtcacttctgccaaatcttcaatattggcttctgaggccgcttgaggattctccatcacatattttgcaatttttttattagttctgcttaattcatcaaacgattgttttaataattgaactggcgagctcataatgatcacctttcatggattgtaagtgtcttattttcatcaatgtaaatattttacaacaaaattcttgcattgtgaaattgtttttcatataattgtgtttgcgtttccattaccaggaaattcaatggtcgaaatatttgaagtctcccggtgataatgatatttttagtgagaagcggtaccgagccaattcttcagcactcgacattggtttaacgatgcagctatattttttgccattatttgaaagcgcttcggccgttgactcaactaatacagaagggaagttatttacatggattatacgctaggtgttgatattggaacaaccagtgttaaaaccgtgctctacgatgttaagggtaaggtgcatggatattccaacaatggatatcccctataccaggacacccctgatatggccgaggaagaccctgaagaaatcttttcagcgatgtctgacggcattaccgaattggttcgaaaggccaatatgaaaccaggagagctgaagggtgttgcattttcctgtgcaatgcatagtttaattcttctggatgagaatcacaaaccactcacccgggcaattacctggggagacaaccgggcggtcaattatgctgataagttgaaggccagccctgagggaatggaaatctataagcataccggaacgcccattcacccgatgaccccactcaccaagctgatttggctgcgcaatgatcatgccgatctattcaagcaagcccgctggttcgttggcattaaggaatacattctttacaaattattcggtgtcttaaaagaagattactccatcgccaatgccaccggaatgtttaacatctacaatatggactgggatgaacaagccctgaaacttgccggcgttacacgggatcaattgcctgatttagttgataccacttatcaattaaaagggatgcgtgaagagtacgctaaagtgctgggaattgacatcaataccccatttatcatcggtgcttcagatggtccactggccaacttgggggttaatgcgattcaacccggggttgtcgctgtcaccattggaacttccggtgccgttcgggttgtcactgataaaccgcataccgatccaaaggcccgggtattttgctactacctagccaagaacatgtgggtcgttggcggccctgtcaataatggtggcgttgtcttccgctgggttcgtgatcaactctgtgccccggaaaaagtcactgctgaacaaatgcacatcgatccatacgacctcttgacagaaattgctgccaaagtgccggctggatccgatggcttgctgttcttcccattcctgggcggtgaacgtgccccaatctgggacgctaatgcccgtggctcattctttggccttaaccggacccacacgcgtgcccacatgattcgggccgttttggaaggtatcgtctacaacctttacacggttgctttggcccttgaagaagtcgttggtcaaccaaccagcatccaagccagcggtggttttgcccgttctgcgctttggcgtcaaatgctgaccgatattttcgaacaggacgttgcgattcctgaaagtttcgaaagtaccgctttgggggcagccactttggggatgtacagtttgggcctgattgacagcctttccgacgtttccaattttgtcggcaccacggttgttcatcacccggatccaaagaacttccaggcgtaccgggaattgattccaatctatattcgcctaagtcgttcacttcaacccgaatacaagaatatcgccgagtatcagcgtcgtcacgaacacgaagatgaagacgccgagaagtctgaatagcacctgtccgttttttatttgaaaggggaaaactatgatattaaagctgctagccttgctgatcggaattattttcctgttggttctgattatcaagttcaaaattaataccttcgtttcgttggtattaaccgctgttgttactgcgatcatgctgcagatgccactaggtacgatcgctgattccgtctcaaatggtattggaagtcaactgggcgaattgtccatggtcttcggctttggtgccatgttagggcgattggtttctgattccggtggtgcttatatgatcgccgaaacgctgatcaaacgatttggtaaaaagcgtctccagatcgccgttatgttggcttcatttattttaggaattgcgttgttcttcgaagttggaatggttttactggttccaattgtcttcgcaattgccgttgaagcaggtgtgccaattctttatttaggaattccaatggccgctgccttgtcagttacccacggatttttgccaccccatccagcaccagttgccattgcgcaggtcttgggtgccaacgatggtaaggttctcctgtttggatttgtcattgcaattattgccgcttatatcgccgggccattgttctcaaagatggctcgtaaatttgcacccgctgcattcgagcgaaaaggaaacctttcttcaatcggtgaagtgaaacaatttacccctgaagaatcaccatcgtttggactgtcagtattaactgccctgttcccagttctgctgttggcgattgccacaatttataaaatgaccatcaatggtggagttgatccaaagaacccttctgtgattgattcaatcattgaattcattggatctccaagtatcgcaatgttgatttcattattcttcgcaatgtataccatgggctggggtcgtaaacgaaccactgctcaaatcatggaatcacttgaaaatgcggttaaatcaatcgccatgctgctattagttattggtggtggtggtgccttcaaacaaattctgatcgacggtggtgttggtaaagccgttgctcaactgttcattggttcaccaatttcaccattaatccttggctggttggttgccgttgttctccgaatcgctttgggttccgcaaccgttgcttcattgacagctgcaggaatcgtcgccccattgatggcccaagctggggttgacccagcattgatggttctggccattggtgccggctcattggccgcatcacatgttaacgatgccggcttctggatgttcagagaatatttcgatttaacaattaagcaaactcttcagacttggaccgtgttggaatcaatcatttcagtcgttggtatcatcatggttatgggactgaacttggttttccattaatgagagagtgtgaactcaggcgctcagcttttgagcattagtttaatacaggccgttaacgctgattttgcgttgacggcctgtattggactaagcggaaaaagctgcctgagagaacacattttaaccagagtgtgcccccaggcgcccagcttttgagcgccatttcaatcacacaaactccaaaaagactcgagcaaaccaatcatatttgctcgagtcttttgtatccagtcaattaaacccgtccagctgctccactcatcactttcattcggacggctaccaagtatgcgacaactgccttcagcgtgtcgccagggataaacaacaggcctgaagtcaatgcaccgatcagtgagatcggcgtcacccaccacagccagagggcgcccatcacgttaacaatcaaaacactgctgatccaaatgacaattagttgaccccatgaatggctcataaacggccgtgagcggcaacaacccatcatgagaggcgttatgagccaaccgaacaaatagcccgctgtggggccgataaagactgctgggccggcttgaccaccggagaggaccgggaaccccaaaaatgccagcagtaagaataccccaactgcgatcgtgccgttctttgaccccaaaaagaggcctgctaacataatccctaagttctgcatcacaatcggcacgggaatgatccctaaaggaattggtggaatcatccccaacacgataatggctgcaatcatcaaggctgtttgtgtcaattgtctaattttcatatcattttcctttcaaaaaacggttaaccgacttctatgcgccgcttaaccgtcattggatattaaattagcctgagtaaccatttccaggcagataaactttcgttacttcaccgcttgaaacggtaatcggttctccggagtcctgcttgaccaccaaggccccatcaccagtaaagtgatcagccagcccagtgatggttcggttccccatcacaatttggacccgcttaccaagggtttctgataacttggcgtattcctgcagaaaattaccgctggtgtaagtttgatacatataaaaaaagttgtcgatgagactggcagcaatccgatttttgtcaattgctgtgttggtcacaatcgccccggctttatgggcaatttgatcgggaaaatcagtggaatcaatattcaacccaatcccgaccaccacattttcatgaagaccgtcttcgagactggaaaccgtttcggtcaaaataccaccacattttttgtcatgaaccaaaatgtcgttgacccatttgacccgaaagtcctcatcgggaaaaaactgttgcagggttctgaccacgcaaaccgcggttccggtggttatcaacccagaatgaatggttcggcgattctgtaaaggaatcaaaatgctcaaatagattccacccttcgccggggaatagaaatgtcgccccagtcggccatgcccctgagtttgcgtatcagccacaaacacctgtggaatggtaaagtcctgactgctgccaaactgcttggcgtaatcgttcgttgaggaaatgctggcaaacgcatggatcgccaccggaaaagtagttgtccgataatgatcgatcacagcgtcatcaaaaaattgggatttttgataacaataacccagccctttgcgtgtggtaatcacatgaccgcggtgcgataatttttgaatattgttgtagacggccggccgactaatttgcagtttcttagccagttcattgccggaaacatagcggccagccgccgttagcaatgcatctaaaatttgtctttgatgattgaccattggccatcccccacttacaatcgtcgttaaattaaatggacacctttatcaacgtagaccacgtcaccggtcatcccagttgacaggtcactcatcaaaaaggcggcgacgttaccaatttcactggtggtgacgctcttttgatcaactgtccgtgactcggattccttcaacaattcaccatgatgtttaatcccagtaactgctaaggttttaaccgcgccggcagaaattgcgttgacacgaatgccattttcgccgagatcagatgccaggtaacgcacgttggcttccaaagcggccttggcaacacccatcatgttgtaatttggaattgcccgggttgagccaaagtaggtcaaagttaaaatgctggctggattattcaagaccggttgggcataacgtgccacggcaatcagtgaataagcactgatgttttgtgccaaatcataaccgtccttggtcgtgttgaccagtccggaagtcaaagtatccttgtcagcataagcaatggcatgaatgaccccatcaattttgccatactgattgccgatagtttcaaaagcctgcttaacgtttgcgtcatcggcaacatcacactcgatcaaatccaagtcgtccggcacaaagcgttccaaactttttttaatgcggtcattttgataggtcaaaataaccttggcgccttgatccaaaatcgcttgggtacagccccaggcgatactgcgtttatttgcaacccccatgatgacgattgtctttccatctaaaaagccactcatatttgagcctccaaatcttatcttcaattaaaaattccggtaacgttgatttcgacggtccaccaaatcatcaattggtaacttggccaattgagaaaattcctgatccaagaagtcacgtaacgcactcaaatcttccccgggttgatactcatgaataattttatcaataatgccatctgctaataatgcttctggagttaatttgagttcttctgcggcttccttgaccttggatgaatctttccacatgatgctggcgtatccttccggtgagagcaccgaataaatgctgtcttcaaacatgaagacccgatcgccacaggacagtgccaaagcaccaccagagccgccttcaccaacgatgatggtgatatatggcaccctgagctgcatcccctgaataatattttgtgccaccgcggacccttgaccatgatactcggattcaacatctggccaagcaccgggggtattcaccagcgctaaaattggccgatgaaatttctctgcctgcttcatcaaccgcaacgccttgcgataaccttgaggcgttggactgccaaaatgtctggcaatattctcatcggtatctgatcccttttgaatcccgactactgtgattggtttatcattcaacaagccaataccgccaatgattgccggatcatcggcttccagtcgatcgccatactgttcaaaaaagtcactggttaaatgattgatcaactcggcagtcgtgattttatcaggacggcgagctgctttcacccgctgatatgctgttttatctgccatagacgttctcctttgtgtgcagagaaattaagcgactcaaagttgctttcatttgtttacgcggcacaatcgcatcgataaagccatgagccatcaccgtttcagcactctgaaagtctttggggggcttttgcataatcgtctgttcgatcactcgccggccggcaaatccgaccaacgcgtgaggctctgctaaaatgacatcaccatccatggcaaaactggcggtgaccccgccagtcgtgggatcgcataagacaacgacatacaatagtccggcccggctgtgttccgcaaccgcccccgatactttggccatctgcatcagcgaatgaattccctcttgcatccgggcaccgccggaagcggtaaacatgatcaccggcaattttttccgggtcgcttcttcgaacaatcgcgtaatcttctcaccggttgaacttcccagactgcccatgacaaagaatggatccatgatgcccacaccgacctgctgcttatcaagggtgccaatacccgtgaggacactttcgttgattccggtgacttttttagcctttttcaccttggccaaatacttttcatcagtgtactggtccggaaccgtcattgatttgtcaatttcatcaaatgaatcaaaggtaattttggcccgtcgtttggccgtgattcgaaaaccataaccacaattgggacaggttttcgtgctgccagcccttaatgaaaaaaaggttgcgtgacaaattgggcattcccgcagcacatgatcgggaatggcatccatccgctttaccagttcttcatggcttggcatattaaaccgactgcgtagcatggaatccctccttatcactcaacacttcattttgaatgtaactggtcgaataaattccctgatgaaatttgtcggtgccaatcaaataatccaaaaagctttggttggtccgaatgccgtcaatttccagttcccctaaaattcggtgcatctttgagataacggtatcgcgatcgttcaaatgaacaatcactttggcaatcattgaatcatagaacggcgaaataaagctgccgttggtgacacctgaatcgattctgacgccgagtgaaccggcggggaaaaataaatgattaatctgaccgggttgcggggcaaaattattagtcggatcttccgcattcaaccggcattccaaggcgtgccccttcacggcagcatcggcttgggtaaacggcagttcttctccggcagccaccgccaattgccctttgaccaattcaattccggtcacttcttcggtaattgtgtgctcaacttgaagtcgggtattcatttccatgaaatagaagtgatgctcatcgtccattagaaactcataggttccggtattggtatatcccagcttaagcgtggcgttggcgacaatctcacccaaatgccgccgctcttcagctgaaatcaaaacacagggactttcttcgatcactttttgatgattccgctgtagtgaacagtcacgctcaggcagatagacgacgtggccaaaattatcggcaatgacttgcatttccacgtgtttggcctgacgaatcaacttttcaacatagatatcttcgtcgtcgtatgaaattcgggcttcctgctgggtctgctcaaaagcatttttgagttcttcaggtcgatcaacttcacgaatccctttaccgccgccaccggctgctgacttcaacaacaccggaaaaccgatttggtccgcgacttgttcggcttgggcaaccgtattgactaccccgtcacttccgggaatcacagggaccccggcttttttcatcgcttctctagcgttggccttgtcgcccatcagagcaatcaactcatggcttgggccgatgaatttaatgtggcaggtttcgcataattctgcgaactcggcattttcggataagaatccgtaaccagggtgaattgcttcacatccggtcaaattggcggcactaataatctgggccatgttcaaataagattcactgggctgcggcccgccgatacagatggcttcgtctgccaaatggacaaacaaggcgtctttgtcggcactggaatacacggcaacagcggtaatccccatatcgtgcaaagcgcgaataatttgaacggcgatctccccacgattagccactaatacttttttaaacatgcgctcacctctattactcaactgcaaaaattaaatctgcttcacaaatctgctgtccttctcgatgaatggtgccgtggccaaggccaatattgtgctttaacttctttaattccacggtaaaggtcaatttgtcaccagggcggaaatcatcttggaagactgcattcttgatgccgccaaaaaaggcgtttttgccttgatattccggcattgacagaattgcggctaccccggtctgggccatcgattcgatcataatcggccgtggcaccactaggttattggcttgtttgttggcaaaaaaccattcattaattgaaatcagtttaacagcaacggcactctcccctggcttgacatcaataaacttgtcaatcatttggaaggggtagcgctgtggaatcacatcttgaacatctggtttcatctcattaccccttcgttacttgaaaaattggttgatcgtattcgaccatgctgccatcttcaaccaaaatgttggagatcgtcccggtcacatcacttttgacctcgttgatcattttcatcgcttcaatgacacaaaccacatcgcctttttcaacgtggtcaccctgcttcttgaaagccggcttgtcaggacttggggcaaagtacacaacgccaaccagcggtgccttgatttcggcaacgttttgggcgaccggtgtttctggctgctctaccgtggttggttgactattttgtccatggcctaaaccatttgtgctggcagatgccgcttgcgcagaatcttccacgacggcgtggtcatcgccctcccgtttgctgaacttaagcttgaagtcatcttgagccaattcaaaattcttcagtgacgaacggtcaaatttgtctaataaacgttcaatttctttctcatccattacctaatcacaccctttaaatgcaattacggcgttgtggccgccaaaaccaaacgagttgctgatggcgtagttgacttcggcatttttattgctgtcgtcaaccagctccacgtcacattcttcatcctgattaaccacaccgacgttgacaggcatttggttatgcaaaatggcaccaattgttgcaacggcttcaatggcaccggcagcccctaatgcatggccagtcattcctttagtgctgctgaccttgacatgatcattattggcaaagacttcgttaatcgccttggcctccgcgctatcattggcgtgagtactggttccatgggcattgatgtaatcaacctgggtttcatcaatcccggcttctttaacagcctgttgcatggcacgtttagcacccttaccttctgggtccggcgcagtcatatgataagcatcactggttgtcccatagccgacaacttcggccaagatcttggcaccgcgagcttttgcatgatcgtaatcttcgagaattaaggttgctgacccctcacccatgacaaacccattacggtctttatcaaatggaattgaggcctttttcggatcggtttccttggaaagagcggtcaaagcggcaaacccggcaatcccgatttcgttgacggaggcttctgtcccgccggcaatcataacttgggctttgccctgcttgatgtattcaaaggcgtttccaatcgcattggtacctgaggaacaggcagttacgattgcttgactggtattcttggcattaaaggcaattgaaatgttaccagcagccatgttaatgatggagtcaggcacgaataatggtgacacccgtttgggactcttatcatgcatcttgatgacctgttgttcaattgttgtcaagccaccgatcccggaaccataaatgacacccagttcttcggggtcaacgccaccgtcaatcagtccagcattttccatggcttcagtggcactgtacaacgcatatgtacagaagaggtcatttcgtttggcaaacttcttatcaacccgttttaaaggatcaaaatctttgacttcaccggcaactgtaatgccagtgggctctgaatcaaatttggtaattggggcaataccaaccttggatgcaaacagattttcaagaaaactgtcaacatcgttgccgattggcgtcacagcgcccaaacctgtaacaacgactctactcatttaattactcctttaacaatctaaattgtcaacccgccatcaaccgtgatgacttggccagtaatgtattggttacccaccaaaaaggcaacggcatcggcaatttctgtcggttcagcgaagcgcttcagtggaatttgatcagtgaattcgctttgtctgcgttcactcattttgtcagtcatatccgtcttgaccattcctggcgcaacggcattggcacgaatattgcgcaatgcgccttcgcgggcggccgtcttggttaacccaaccaagcctgctttacttgcggaatagttggcctggccaaggttgccgtggaggccggaaatactggaaatgttgacaatcgagccttttctggccttttgcattaatttcatcgcaaacttggtcatgttaaaagcgccgaccaagttagtctccaagaccgcctgaaaatcggctaatttcatccgactgagcaatttgtccttggtgatcccggcattattgaccaaaacatcaatttggccatatttttcgaccaccgaattgatcatttgctcagcatctgcttcactggcaacgtcgccaactaagacatcgaatgaatacccggcagcggctaactgctgactgtcttcgtcgcttaattcatgatgggcattgataaccaccgtcatgccatcgtcagccaaccgtttggcaattgccaaaccaattcctttggcagccccggtcactaacgcaacttgttttgtttccgtcattatttcaccagctttttgtttgatcgaacttgatttaaggtttccacactatcgacatggaatttgtcagcgttacaaatgagcggcttggcaaatttcatcaaggtatcaccagggccaatttcaattaaaacattggcatccaggttcaataattccttgaggcattcgttaaaatgcgttgggttgacgagttgattaaccagcgtttgcttgacgttcagccgcgtaaacggcttgataatcgtattgctgaacaccggaaaatcgggatcttgaaaattgaccgtctgcagtcgctttgacagctcgtcgctggcttcctgcataaatggtgtatgggaagccacggtcattttcaaaggaaccacccgcttgatgccgtgctcatggagatactcggtcgcagcgtttaaaccggctgccgatccaccgatcacaatttgggtatccgtgttgtaattggccggatagaccggtccgacttttgagccgacccggcaggcctcatccacaaggttggcattagcttttaaaacagctgccattttacccggataatgctgtccagcctgatccatatagtgattgcggtcgccgaccagcggcagaccatcttcaaagctcagactgtcagcggcgatcaggccgctatattcgcccaagctcaatccggtggcgccgactggctgccctaaatcatgcgccagaattcgataaattcctgtactcaggatgacaattgaaacttgtgtattggcgggatcatcaaaaatctttgaatcactcatgtcttttccaagtatctgagaagcttcttcaattgtttgacggtaaatcggctcctgctggtagagatcctgtcccatcccggcaaattgtttaccctgaccgctaaataaatatcctagtttcaaattatctacctgcctactttctgactacttggtttgttgttttaaaacgtaatcaaccaactcgccaacggtttccataccttcatcggtgtcaatttcaatatcgtaagtatcttcaatcttgtcgacaacttcaaagatgtccaagctgtccaaatcaaggtcgttcttgaagttggtatcttccttaaccttgtctgcgtcaacgtccaattggtccacgataatatcttttaccttgttaaatacttcttctttagtcattttaatttcctccaaattttatgttattccaatttttatttttagtacttgataatcattgtgccaacagttaatccgccgccaaatccggatagggcgatgacatccccccttttaatgcgttgtttggcgaccagctcagcaagcaaaatcggttcgctggccgctgatgtgttgccatattcattgatattgacaggaaattgattcatcgaagcgcccaaagtatcggcaatcttttcgatgatccgttcgtttgcctgatgtaagacgaagcagtcgatgtcatcaatggtcaggtttgccttctcaagggcacggttaattgattctggaacattcttaaccgcgaaaccataaacgcgatggccattcattttgaaaaatggcgagtagctggtttccggtgcggcaaatggtgacttaacgccaacttggccagctgttaaatgcttacccagcttacccaacgtcttcaagtcctcagagataaacgaaccggactcactagattggttggtcatcaataccccagccgcgccatcgccaaacaagacggccgtcgaacgatcatgccaatccaaaagcttacttaatgtctcggccccaatcaaaatggcgtgcatcggccgatcagctttcaacatctgacgaacgaccttcaagccgtagacaaaccctgagcaggccgcgtcgatatcaaaggcaatcgcctgatcagcacccaggttgccttgaaccatggcactgactgacggtgtcaaataatccggtgacatggtagcgacaacgattagatcaatctcagtgggtttgaggccgctttttgccaacagctttgtcgcaaccgcggtcgccagtgaactggtcgtctcttcaacggcaacgtgacgccgcttgattccggttcgttgagtaatccacgcatcagaagtatccatcatcgatgaaagctcatcgttatcaaccacgcgctgtggaactgaactggcagtctcaatgattttgaaatcttcaaaggtcattttgcagatacctcatcaataaagtcttccaggttaaccatcgcctgcttgatcaaccgaatgtcgtcatcgtcaaagcccctcaagaaccgtttgaccaacaatttatgaaacgcgtcatgggcccgatacaacaatcgccccttactggtcaatcccagattgataatccggtgatcttcctggttggcgattcgcatcacataccctttgcgttccaaattattcaaattggcggtcaaagttcctttgctcaatttcaaaatgtgggccacttccgaggttgtctttcgatcatgcaggccaatggtatgaaccaagtgaacttccttcgcagtaatgtctttgaaccgactttttcgaatttcgctctcctcaatccgcatgatgctgtcgtagacgttgatgagcgactcattgataaagtcggtatcttttttaatttcatcactttgcgaattcatttcttagctcccctagactgataattaaattttcttctttggatcagggacaataaaggttaattctgcagagcaggcgactttgtcatcaaccttggcttcacacttaactttgcccatgttctcacgctgcttttccatggtaacgtgaagttttaagacatcccctgggcgaacaacttttctaaacttggcattgtcaattgcgccaagataagctgttttgcctttgtacttttcagttttcaaaatcaagattgaagccgcttgagccaatgattcaataatcaagacaccaggcatcacgggatttccggggaaatggccctggaaaaattcctcgttaatcgtgacgttcttggtaaccacaattgactcaccggggtttaattcatcaactttatccataaacaaaattggataccggttgggaattaaatccataatttcagatgcatctaatacactcattgatttcttcctttcacttacagggtggtcaatgccatttaaaatttagttcgactatcaaactattagctaaaactaaacgctcaaaattgacatttaccgaggttcttttcggaacacacaacataataacctaatttagtttgaatatcaaactaaatttcaatacaacgtgttgcgtttctgaagtttaccacaaaaggccttctgtgactagtcgtccggaaatggcagacgtctttcttttgaacttgcgggttggcctaacaaaaaggccgagacataactcattatcggttatatctcggcctcgcttatgtgcgacttttgtgaattccactgttatctagttaaaacgtgggaaagaggacagcaactaaatttaaggcgctccagccgaaaatctgactcggtttcctggtgtctttcttttatttggattaaacctgtgaaagaggacagcaatcgaaatttaagccgctccagccgaaaacctgactcggtttcctggtgtcttacttttatttggattaaacctgtgaaagaggacagcaactgaattttaaggcgctccacccgaaaacctaactcggtttcctggtgtcttacttttatttagattaaacctgtgaaagaggacagcaatcgaaatttaaggcgctccagccgaaaacctaactcggtttcctggtgttttactgttatttggattaaacgtgtgaaagaggacagcaattgaaatttaagccactccagccgaaaacctgactcggtttccgtctggagtggcttaaatttcgattgctaaacgtcctctttcacactctgtttttattcaactgtttcataaaccaacgttggtttgttggcggactcagagatttcaatattgtcatacaaccgcttcttaatgtcatcgacatcgtcacgattgctatatattgtcagcagtgactccccggctttgacctggtcgccaatcttcttatgcagcataatgccaaccgcgtagtccagctggtcatcggccttctgccggccaccgcccaagagcatgctggcaatccctatctcatcagccacaattttggaaacgacgccgctgcttggtgcgggcaggtcaatcttgaattgagcttgcggtaagacatgttctggatcgtcaatgactgccggatcgccgccctgatccgcgatcattgcgcggagtcgctccaacgcctgaccgttatggatcactgcggtacatttttgctggccttcttcagtcgtttccgcttggccacccataactgccatgtagccgccaatcacgacgatcaatttttccaaatctgccggcccattgccctttagcaaatcaattgattcttggatttccagcgcgttaccaactgcatcacccagcggctgattcatgtcggtaatcagcgccatacactgcatgccgacacctttgccaatctcaaccaaggctttagccagcgctcttgaatcgtccagggtcttcatgaaagctcccgcaccggttttcacatcaatgaccagcgcgtctgcccccgaagcaatcttcttactcataattgaactggcaatcaatggaatagagtcgaccgtatcggtgacatcccgcaaggcataaatctttttgtctgccggggcaatattcccagttgcgccaataattgccagttggtcttttttaagttgggcaataaagtcatcctcgctaatttcaacctgataccctgggattgcttccagcttgtccaatgttccgccggtatgtccaagcccccggccggaaatcatcggtaccggaattccaagagcggctaccacggctgccaatggaatactcgtcttgtcgccaacccctcccgtggaatgcttatcgactttcacgccgggaatttggctcaagtccaaatggtcaccggatttcatcatcgtcatagtcaatttggcttgttcctcgctggtcatcccttggaagaagattgccatcaataaggcactaatttgataatccggaatgtcgcccgaaaccaccccatcgacaaaaaattgaatctgctcatctgtcagctgtttaccagctcgtttggtgtgaattacgtctaccattctcattgtggattctcctttgatttttcatttaaaataaagcgttttcatttgagcgttgaacaaacgcccaaccctgattggttcgaatatggattgggcgttgccgttaataatctagtaagagttgtgccaaactttgatccagaattgcgcaattggtgtagtgcgcattgattgccgcatggactgctgccgcctttcgattgccgctggcgaccaagattgcgtgcggcttatcttttaaatcatccagctgaatgccgatggtccgatcgttgatttcttttgagacaatttggccattttcatcaacaaagcgtgaaaaaatatcgccgacagccagtcgctgaatttcagctttttcctgatcattgaaatacccaagttggaaaatcaatgcctctgatcgaacagtcccgacagtaaacaaggcaacgttggctcggcgcccaagatcaagaatgtgtttgatatgccggtcggtttcaaccatttccttggtgacttggttatcaaatatcaccggcagcggcagatactcgggatgggtatgataggcttttgccaattcattgacagactcataggcccaggttttttcctgggaatgactgatactacctttgagttgaaccacctgaacgccggcaatatcctgctcttcgagttgcttggtaaccgaatgaatggtttccccccagccaatcccgatgatgtcaccagcttgaacgttggcagacaaaaagtcggcggtatagcggccaacaccgtcttgaatactgacggtcccgccgtaattgtttggcaccacatggaattcaattccgtacttatcactcaactgtttggacaacacctgcgaatcaaccaagggattgacaatctggatcttcaccaaaccgttatccttggcatattgcagcaatcgtgacaccgtcgggcgggagacccccaatcgagcggcaatttcgatttgactcaaattatcctgaaagtataattcggccacgcgcaagctttgtttgagtttggtgatgtccttaatttcatccatgtgatcgctccaatttctctttatgacatatttttaatggcggtttccagtgataatctggccatttcatcaaatgacgtttcccgttccttggcggggagggcttcgccggtcagcaaatgatcactgaccgtcagaatggtcagtgcgcgaatgtgatgtttggcagccagcaaatatagcccggaggtttccatttcagttgccaaaacgccataatcaattaatttgtggatatccaactcatcgttgtagaaacgatcagcggcaaaaatgttgcccaccttggtgttaattcccatttgttgcgcggtatggtaagcggaatccagcaggccaaaatcagcaattggcgagtagtacattcctgggccaaaggtgttttgaatgatcgatgaatcggtggtcccggattggcccaaaatgacgtcacggatcttcacgtctggactcatcccaccacatgacccaacccgataaatggtcttaaccccatattctttaatgagttcagtcgtataaatagccaaggatggaatccccatcccagatccctgaaccgaaattcggtgacccttataagttccagtatacccgaacatgtttcggacttcactgtagcggacaggattgtccagataagtttcagcaatgaactttgcccgcagtggatctccaggcattaaaactgtgtcggcgatttcgccgggctttgcgccaatatgtgtactcatatgattgcctccgtttatttcaaatcagccagaaaactatcgccaaccccattgccggcaacgttaaagttatccagcacggttgcgccaaaatcggcaaaggttttacggatgcctaagctatcggcatgttgcattgaaggtgaataggccagcaatggcaccagttcgcgggtatgatcggtgcctttaaaacctggatcgttgccgtgatcggccgtgatcagcagcaggtcgtcgtccttcaaattcttcagcaccgttcccaaacgtttgtcaaaatccattaaggcttggccaaagccaatgggattacggcggtggccgtacattgcgtcaaagtcgaccaagttggtgaagcaaaagccggtaaagtcttctgccatcacgtggtcaacgtgatccatgccgtccatattactttcattatggtagccttcatcaattccgtggcctgagaaaatatcgttgattttaccgatcccaacggtgtggacccccgccttctgcaggtcgtccaaatcagtcgtgccagtcggctccaacgtgaagtcgtgccggttggcagtccgagtgaaatgatccttatccggaccaacgtatgggcgtgcaatgatccggccaaccgtgtattcgggaccgttgaccaacgttctggcatactcgcaaattttatagagttcttcaagcgggatgacgtcttcgtgggcggcaatttggagaactgagtcaccggacgtgtaaacaatcagatccccagtcttcatctgttgctccccgagttccgcaataatcttggtgccggattcgggccggttaccaataattttacggcctgaaaaatctgccaagtttttgagaatctcttccgggaacccatttggaaaggtgctcaagggcttttcaaccggcaaccccatcatttcccagtggccgtccatactgtctttgccggcggaaatttcttgcatcttaccatagtagccgattggtgaagtcactttgtcgacgccttcaattgccgtttggcgcaaattggaaatgccaagtttttgtaaattgggaatctgcagctttccctcataagcctcgccaacgtgtcccaaagtgtctgaaccgacatcgccgaatttagcagcatctggtgcttcgcctgttccaactgagtccattacgatgccaaaaatgcgtttatatttcttaactgtcatctaaattcctcccctacaaccagctgcttaagataaaatcttgacggttgcgctgacacctaaccggctggcaccagcttcgatcattgccaaagcttcttctcgagaatgaattccaccggaagccttaacgcccaacttgttgccgacagtctttctcattaaggcaacgttatgaagggttgccccttccgagctaaagccggtcgatgtcttcacgtaatcagcaccggcagcttcagaagcgtggcaggcgttgacaatttgctcgtcgttcaataatgatgtttcaaaaatgactttgagcattttgtgcttggcgtgaaccgcttcagcaacggcttgaatatcggcagtgacgtaatcgagattgccgccgatcagttcaccgacatttaaaaccatgtcaatttcttcggcaccgtcatcaatcgccgtaatggcttcgtaaactttggtttcagtgttggttgccccgagtgggaagccgacaaccgtaattgggttaacagttgtgtcctttaaaagctcggcggcaagtggaatccagtgtgaattgatacaaacagaagccgtattatacttgattgcttcttcacaagtttggcgaatgctggcctcagttgcctctggttttaagtttgtgtggtccaaatactttgcgagttgagcagtcgtaatttcttttgtcatggtcatgtaacccctttcatttctttacaaggatagtttacaggaatttagaacatatgtaaagatgtttgttgaaattttgttctgttatgtgaacttgtgagcttttagtgggttgataaaagccatcgtccttgaggggcggtggcttttgggaggtgggaatattgattagttttactttctgttgttgaaaacatccatggttgcttgtgcatgttaaacgagctggttggtggagatatcgataatccgagccttggttgtccctacttacatagtgaaaatgtgctccgacgaccctgatccctactgcataaagcgaacccttcaataaggcacagaaccacgccttattgaagggttcactttatgctccgggatcacccgggtctcgtcgcactctgttctgaaatgtgctcctcagcccagcccctaacgcataaggccgaagcgcaaatcgataagcacaccccgcttatcaattcgcccttcggccttatacaccggggctaaccgggctgactcgcactctacttcaagtctccaatcgtattcacattcttcatatacgttgggacagccaagccgaccttggcgccatgcaagttgacacccaaatcgtcaaacttgcccttgtagtccttataatacagtccctgagttgtcggcagccaggcacttaccatcccatccgctgcatttgtagcaattgatgcccacagtggttggacttccattgcttggatttccaccttgtaacctaatgaccgcaatacgttggccaccacattggttgaggcaatttcagaatcccaggcgacatacgtcagcttgatcgattgaccatgcacgtgggcaatacccttcgtccaggtatcaacctgcttttgattagccttgatccaatcattggcagctttatgcggatcttcgccattgttgactttcagcatcacatctgccatttgttttggccgccaattaaagcggttcagcatttcgtacgcctgtggtttgtccttcttcaatccttttcgaacgatggtgtgaatgtcttcggctttgccgtatacgttcttaggatctttcaaaaattttaaattgtatttggtaaacatccagtgcggagtccagccggttacgacaatcggctgatgatttttgatggctttacccaatgtactggtcattgccgcggtggaactggtctgcagctgccatttacctttgtccaaaccatatgccttcatagccttctgcgtactggacatgatcccggcaccggcctcaatcccggtaattgtgtagttgatctgcttgccaaggctttcgttagcatgataccgagcaggcttactaccacatgccgaaaggagaatcatcgagaagaacaaggcaatggttaatagaaatcgattgttcttttttcgcatagtaacccccttctatgacttagggacttttgtgcggttaatcgcctgggtaatccggtcaaggatgattgccagaataacgattgccaaaccggcagcaaaaccgccaccagcatcgtttcgaccaacggcaaagtagaccttgtttccaagtcccatcgccccaatcatcgaagcaatcacaaccattgacaacgacagcatcatactttgattaacgccggccattaaggttgatttcgctaacggtaattgaaccttaaacaacttttgccaacccgtagatccataggaatccgctgcttcaatcaagtcattgggcacttgacggattcccaggttggtcattcgaaccgtcggtggcattgcaaaaataacggaggcaatgacccctggaaccataccgatcccaaagaaggcaactgccggaatcaaataaacaaaggctggcattgtttgcatgaagtccaaaattggcttattgatcaccgcaaaaacttttgatttagccatccaaattccaagcgggactccaatcaccaacgcaatcaaactggatgtcagaaccagtgtgagggtctgggtcatatcccgccagaaaccttgattccaaatgtaaaggagaccaatggcttcaaaaatcagtaatgtccaatgcttagtgttgcggttcagccagtaggtggcccccagaacaatcagcatgaacagccaaatcggcaggatgtcaaagacccattggaaaccgttaatgatgccgccgataaaattggtgacaccgttaaagaagccttcaaagccggcaagccagtcgacaaatttatcaatccagctggagactggtaattgtggaatgttattcatcctctgtcacctcatttcctgaaatggcgcctagaacggcacctcgaatgatgattcctagtaaatgtttttgatcgtcaagcaccgcaaatggaatcggtgtctgcgagattttttccataatctccgtaatcggtgtgtctggatgcgtcgttgggacatcggtttggacaactgacatcagatcagggtttttctgtttaattaatcccatcacgtgatcagcatccgcaacgccaacgaattcccgcttactattgacaacgtaaacagacgaaatttcattctcacgcatccgacgcattgcgatccgtggaccatccttatcgatattgacaaaagttgggcgaatcatcacattggaagcagttaagaccttggtccggtcaacatcttcgataaatttctcaacgtattcgtcagcaggctgagtcagaatctcttctggagtcccggtctggacaatcacgccgtccttcatgatcataattcggtcaccaattctcagggcttcgttcagatcatgagagataaaaacaattgtcttgtgtaagttctcctgcagatccagcaattcatcctgcatatcttttcgattcaagggatcaagggctgaaaaggcctcgtccatcaacagaatttcagaatcagttgccaatgctctggctaacccaactcgctgctgcatcccaccagagagttgggttggatattggtcgtcgtagccgtgaagaccaactaattccaaggcatcgtgggccttttttaagcgttcatccttgtcgacgcctttaacttccaatccgtaggcagtattttcaatgattgtccgatttgggaataacgcaaaattttgaaagaccatgctcattttgttgcgacgaacatccaacagctcttttttatttaggtctgtcaaattctcgccatcgatcattaccttgccggatgtcggctcaattaagcggttaatcattcgaatcatggtcgacttaccactccctgataatcccatgatcacgaagatttcaccatcattgacctcaaagttggcatcgctaacaccaaccgttgccccggcattttgtaaaatttcagcttttgacttaccttgttttaatagttcttcagctttttgaatcctgcggccaaagattttggtaagatgttgcacttgtagttttgctgtcatgtgctcctccttacatcattcaggataaataaaaatcaattaccggcctaaagcacaaacgtatgtggaagccagtaattgaacgacttataaaaccttaacaaaaatatgcattcagttcaaccatttagcaaatccgtcagattccctcactgggggattgtaaccggttttatggttgaccttatctacataatagcaattttatacatttgcactgtatcttgttgccggggttgctacatttacttttagaataggatttcaacgggattggaaaatatttttggctttttttaaatttgctgataaaaaaagagggaatcaggacaaaagtgattgcttttgtcctgattccctcacacattctctgttaactgcaacattgaatgacctctggcaataatgaaaatcgatggaatcatcaattcgtttttgtaaattgaacaaatatccgttggatgggctcattcaacgcttaatgaccacgttccaagacggtaattgattcaacatgcacggtttgtgggaattggtcaacgggttgaatcggttgattaacctgataaccttgctcagtaaataatttaacatctcgtgccaaagttgccggattacatgacacatagaccactcgcttgggctgcattttcaccacgctgtcaatcaaactggcatcaaggcctttacgcggcggatcaacagaaatgacatccggctttaagccgtcttcctgccatttggccatttgcgtctcggctttgctggcaacgaagtgcacattggttaaattgttgagcttggcgttcttcttagcatcttcaacagcttcagggacaatttcaaccccataaacctgcttggccacgcgggccatcgaaagcgaaattgtcccgattccacaataggcatcgatcacaacatcgtcagccgacaagtcagctttcttggtcgccaaatcatataatttttccgtctgcaccgggttgacttgataaaatgagctggctgaaatatcaaacttcagtccaagcagggtatcctcaatggtactcttaccagccaaaactttatttttcttgcccatcaaggcattcgttttttcaggattgacattttggacgatacttttcacttcgggcagtgactgctcaacttcagccacaatctcgctactgcttggcagtttctctgttctggtaatcaagacgatcatcatttcatgagagtagtagccgcggcggaccatgatgttgcggacaacgcccttgttggtttgttcatcatagggttgaactctgaacttgcgcaaaatgtcacgaacaaccaccactgcctcatcaatcttgggatcttgaatatagaagtcttcaatcggcaccaagtcatgagagtgtttccgataaaaaccggtttgaagctgcccattaatggagcggacaggaatttgagccttattacgatagtgggttggatcgtccatgccgatcgtgggattaacagtcacatcaagcttcattttatcaaagtcaacttgaatttgatgttgcttgaattttaattgcgcatcatattttagatgttgaagcggtgcaattccggtttgggtgtaagctttatccaccaattcaacccggtctttactcttttgattgatcttaactacccgtccgaaggcaaagttctttttaaccttaataaccttcatggtcacgttttcggttggcagagcattttcaataaaaattgggaaatcatcaatcttggcgactcccagaccttgatacgttaaatcagtaatgtcaacgtcgtagttctggttcttttcaactggtaccatctttttcatttattcacctttttaattcctagaaacaaaaattgcgaaacgaaagcttcgtaacgcaattataacatcttattaaactattctttatcagggagtttgtcaacgcctgtgacgaagttcttttcaactcggcgcatctcattggtttcatcagagtacgcatcatcgggaatttcgtcggtattggcaaaaaattcaatgtgttgtttgagatcaacgaaagtcatcggtgcatctccaccatattcaccgtccagattgatctgcattcgatcatgaaccggcttggcagtgactttacgcacctttttatagataatccgtggatcatcgacatgccggccaccgttgaggacttttgatgctaaatggagaatttcaaccaagttgctggttttaacgataattaaagtgaattttccatcatctaacgaagcgtctggaacaatttgctcaaacccgccaaccgagtttgttagggccaggaaaaacatcgaggccttacctttaaactcttcatcgtcatacttcagatccatctcaatcggcttaatgcgtggcaacagttcagctccacgaaccaaataggccaagtaaccaaagaaggttttcaagtctgagggaacatcgtaagtcagttcggttagcaatccaccagcagcaatattgataaagtaattttcacctgctttaccgatatctatccgcagggtttggtccttcaagactaccttggcagcctcgacgggatcttctctgggaatgtgcagcgctcttgcgtaatcgttagtcgttccagcaggaataatcgccatcttgggacgcttcttcagtggcgcgatgccgttaaccacctcgttaatggtaccatccccacctgcagctaccacgagttcaaagccgtccttggcagcacggcgagcctcgtttttagcagaatccttggcgggggttgtcgcataagcgctggtttcataaccagcttgctcaaaaatattcaaaatgtcgactaacttttgcttgagaagttcccttcccgaagtaggattataaataacccgggcccgttttcgcatatccatcctgactttctatttactcattgaatcctttagcattttgttgattacttgcgggttagctttcccgtgggtttgtttcataatttgaccaaccaagaaaccgatggcccgatccttaccattatggaaatcttcaacagattgtgggttagccgctacgacttcatcaacaattggctgaagcttggctgggtctgacaactgaaccatgcccttgtcttcaacgaatttcttgggctcttcaccattggtgatggctttaaagactttcttagccatctttgatgaaatcgtgccgtcagaaattagtttgatcatggtggccaaatgctcaggggtaatcttggtatcttgtagttcaacctgattatcattcatataagcattaacgtcaccttgcaggtagttggcagccaatttggcgtcggcaccggcagcaatcatcttatcaaagaaatcagacatttccttggtctgggtaatgaccattgcatcgtaatctgtaatcccaagttcattgacgtaacgctcacgacgttttgcaggcggctcaggcagttctgattgaatctcgtcaatccagtcctgggaaatattcaaaactggtagatcaggttctgggaagtaacggtaatcatcggagccttccttagtccgcattaagatggtttggccggttgactcgtcaaaacgacgggtttcctgggcaattttgccgcccgacatcaaaacacgttgatgacgagcttcctcaaatgccaaaccttttttaacatacgtgaaggagttcaaattcttcaattcagtcttggtcccatattcctgctggccaacggggcgaacagaaatgttaacatcgacacgcatggaaccttcttccatcttaacgtcggatacacccgtgaactggataacctgacgtaattgttccaagtaggcatatgcttcatctggagaagaaatgtcgggtttggaaacaatttcaatcagtggcgttccctgacggttcaaatcaacgtaagaatattcggaagcatgcgagttcttaccagcatcctcttcgatatgcatttcagcaattccgatcttctttttcttaccgtcaacatcaatttcaacccagccatcatgggcaattggggtttctgattgagtgatctggtaagctttaggattatcgggatagaagtagttcttccggtcaaagtgtgggtggcgttcaatttgggcgtgaagtgccaaaccagccatgatgccgtcatggacaactcctttattggtggttggtaaaacaccaggatatccccagtcaatgacgttggtattggagttgggttcatcaccaaattctacaggagatggactaaaaattttggaattggtttttaattcaacgtggacttccagtccgattgtcgtttcaaaattcattagttgttacctcccatctttggtgtttgttttgcaaaatcagtttcttgttcaaatgcactacctgcttggtaaacggtcaattcgtcatatgggcgaccaatcaattgcacacccactggtaagcccttggagaacccggcaggaattgacattcctggcaagccagccaagttaaccggcagggtcaacacatcgttcatatacatggtcatcggatctgagacatcctcgccgattccgtatgcaggcgtcggtgcagtaggtgccaaaatcaagtcatagtctttgaagacattggtaaagtcattaatcatcaacgtccgaacttgagcggcttttttgaagtaggcgtcataaaaaccagctgaaagtgagaatgttcccagcatgattcgacgcttaacttcgtcgccaaaaccttctgaacgggatttaacgtacaagtcttccaagtctttgacatcttttgcccggcggccataacgaatgccgtcaaaacgctgcaggttggaagaagcttcggatgaggaaatgatgtaataagccgccacaccgtacttggtatgtggaagtgaaacttcttcaacggttgcccccaactttttgaaggtttccgcagtatctaagacggtttgcttgatgtcgtcatccagtccctgggccataaattcagtaggaattccaattttcatgcccttaacacctttgttcaatgtgctggtgaagtcgggaacttctttagtcgaagaagtcaagtcatgctcgtcgtggccggcaatggcgttcataatcgttgcattgtcactgacgttacgagtgattggcccaatttgatccaaactggaaccaaaagcaatcagtccccatcgtgaaactcggccataagtcggcttcatgccgaccacaccattaaatgatgctggctgacgaatagaacccccagtatctgaccccaaagcggcaatgacttcaccggcagcaacagcagcagctgaaccacctgacgaaccaccaggaactttggttgtgtcccaagggttatgagtaatcttaaatgcagagttttcagttgacccgcccatggcgaattcatccatgttggtcttaccaactgtaatggtgccaagtttgttcaacttgtcaacagcggtagcatcataaatcggcttgaagttttccagaattttcgacgctgcggttgtggtcaagcctttggtcaccatattgtccttaatggcaattggcattccggacaaaaggttatcagcgtcaatgcccttagcatcaacgtcggcagctttcttcaaagccccttcatcgttgacagtaataaaagcgttgatgtcattatcaacggatttaatgttatccaaagtttgctgggtcaaatccttcgcagagatttctttgttgaccagttgtttgtgaatgctggaaagtgattgatcgaaataattcattattcgttatccccgctttcatcaataatggttggcactctgatgtagccatcggccgtgtctggtgcgttatcaagcaatgcttgacgttggtgccaatcttcggcaatatcgtctcgcatcacgttaatttgatcagtcacactactggtaggttcaacgccgtcagtgtcaacttcgctcagtgtttcaaacaacccaatgatttggtctaattgagtggtgaaatatggcagttgatcgtcggcaatttttagctttgctaattcagcaacgtgttttacttgatcttcggagatcttttcagtcattgaaatccttctctcttctgaatatatccaaaatttaataacaacaataattctaccatataaagaatcgcattttttagaaattaataactatacaatgcggattgttttaatgtttttgttccaaacgttggccctgcacaagccatatattatgatgttgccgccttaaattattcgattaaatatgccaaagatcataggattgagaaaccaatattttatattttggcatgtcgaattggcccattcatggatggtattgtaaaaaaggctcacgcaattggtggggaggtatttgtcaatcctgatggacatgagtggatgcgtgcaaaatggagtctgccagtgagaaggtattggaaactctcagaaagcttaatggttaagaatgctgacttattgatttgtgatagcaaaaacatcgagaaatacattcattcagtttatggagaatattctcctagaactacatttatcgcttacggatctgatgtaaaaaaatcggaattgagtgatagtgcgccgcaactaatcgactggtttgataaattcaatgtaaagcctgaaaactattatttgattgttcgaagatttgttccagagaataattatgaaacaatgattcgtgagtttatgcagtcctctactgccaaaaatttggtcatcattacaaatgtggagcacaacaaattttttgataacctcaaggaaaaaacacattttgatcaagataagcgagttaagtttgtgggtaccgtgtatgatttagaacttttgagaaaaattcgtgaatctgcatatgcatatttacatggacattcagttggtgggactaatccttcattactagaggctttagctagcacaaaattgaatttattatttgatgttggattcaatagggaattagctcaggatagtgcattatattggagcagagaaaaaaattcattagcaaatataattaataaagtagatcatttcaatgatacggacattaataaacttgaaaagaagtctacaatgcaaataacagagcagggaaccgtgctaatctagctggactgcctgaggatcgggttaaattagttgtcggtgatgtggctgacgctgaattggttgataagctggttaaacatactgatgcggtagtgcactatgcagcagaaagtcacaacgataattcgttgattgatcctagtccgtttattcaaactaatattattggcacttatactttgattgaagcttgtcgaaaatatgatgtgcgttatcatcatatttctactgatgaagtttttggcgacttgcctttacgggaagatttgcctggtcatggtgaaggtgttggtgagaagttcacacctgattctccttacaagccaagtagtccttattcttcgtctaaagcaagctcagatttattggttcgggcttgggtgcgttcgtttggattgaaagcgaccatttctaattgctcaaacaattacggcccgtatcaacatattgagaagtttattcctcgtcagatcaccaatattttgagtggtattcgtcctaaattatatggatcaggtaagaatgtgcgggactggattcatactaacgaccattctcgtgccgtttggttaattttgactgaaggcaaattagaagaaacctatctaattggtgccgatggtgaaaaagataacaagactgttcttgaaatgatcttggaacaaatgggacaacccaaagatgcttatgatcaagtgaaagaccgtcctggccacgacatgcggtatgcgattgattccactaagttaagaacagaattgggttggaagccagaatttactgattttaagacaggccttcaacatacaattcagtggtacacagatcatgaagattggtggaaagatgaaaaaaaggctgttgaaagtaagtatgctaaaaacggccaataattattagcgggtgaataacctgctttttttgataaaaggagtaactgaaaatgaataatattttaattacaggtgcgaatggtcaacttggaaccgaacttagaacgctattggatgcaaaggggatttcttacactgctactgattctaaagagctggatatcacgaatgctgaaggcgtgaatgcctattttcaagaacataagcctgagttagtttttcattgcgccgcttataccgctgttgatgctgcagaggaagagccgggaaaatcaattgacgaattagtaaatgtgacaggcacgcaaaatattgctactgccgctgaatctgttggagcaactctagtttatatcagtacggattatgtgtttgatggtcaaaatgacggtatgtatgaagagatggataaacaaaaccctcaaaatgaatacggtcgaactaaaagtttaggtgaaaaggctgttcgtgacacaatgagtaagtactacattatcagaacttcatgggtatttggtaagtatggtaagaactttgtttatacaatgctgaacttgtccaagactcatgacgttttaactgttgtggatgatcaagttggtcgtccaacttggacgtatacgttagcacagtttatgttatatgctgttgaaaataagattgcttatggcacgtataatttgagtaatgataatcaagcgaattggtttgagtttgctacggaaatcttgaaagataccaagacagaagttgagccagtgagttctgcggagtatcctcagaaagcccaccgaccagaacactctgttctttcattggaaaagaccaaagcaactggatttaagattccaacatggcaagaagctttgaaacaaatgatggcaattattgataaataatgatctaaatgtgataaaatatacttcgggaaaatttgacaggaatgttatgtcattaattaatgtaactttgagaggagaaattcatgaattatttagtgattggttctggcttgtttgggtctacgtttgcttacgaggctgcaaaaagggaagcgcaagttaaagttattgaaaaaagagatcatattgcaggtaacatatatacaaaagaagtagaaggtattcaagtacatgaatatggtgctcacatatttcatactaaaatgccaaaaatctgggaatacataaacaaatttgcagattttaataattacattaatacacccattgccaactataatggtgaaatttataatatgcctttcaatatgaacacttttaataagctttggggagtagttacgccagaagaggccgaaaaaaaaattgaggaccaaaaacaaagtgtcaaattgaatggtaagccacagaacttggaagaacaggcaatttccctagttggaccagatgtgtataagaaactggtaaaagggtatacagaaaagcagtggggacagtccgcaactgaattacctgcatttattattagacgtttgccagtccgttttacgtataataataattattttgatgatccgtatcaaggaatccctattggtgggtacactcaaattattgaaaagatgttagccagtgatcttgtcgaagttgaaactaatactgatttctttgacaaaaaagaagaatatcttaagtctgacactaaaattatttatacaggaatgattgatcagttttttgattatgaattgggagagcttgaatatcgtagtttagaatttgagactgaagtaaaagatgtagataattatcaagggaatgcagttgttaattacactgatgctgagacaccttatacacgagtgattgaacataagcattttgagtttggaaaaggtaataaaaacaagactgtaattacacatgaatatcctaaagcttggcatcgtggtgatgagccctactatccaattaacaataagcggaataaagagttgtatacacgttatgtcgaattggcacgtaaaaaggctcctaacgtcgtatttggtggtcgtttgggtcaatatcgttattacaatatggatcaaacaataatggcagcattacagacggttaaaaaggaatttggagaataataatgcaggtagttaaaaattacctctataatgcatcgtatcaaatctttattttattggttccattaataacaacgccttatctagcacgagtattgggacccactggtgtaggaattaatgcttacaccaattctattattcagtactttattttatttggaagtataggagttaacctatatggaaatcgacaaatagcctttgatcgggacaataaatttaagttaacaaatacgttttatgaaatatttataatgaggatagttacaattacctttgcgtatttagtttttttgatttttttggttgttattggaaaatatcaaattttctatttagctcagtctgtttctattattgctgcagcatttgatatctcttggttctttatggggatcgaaaattttagcgtgacagttctgcgtaattttgttgttaaaatcattaccttgatttgtattttctcttttgtgaaaacttctgctgatttaacagcctacattctaattttatctttatctttgttggttggaaatatgacgctttttcctagccttagtaaaaggatcggaaagcttcattttaagaatttgcatatctggcaacacttggttaccatcgatcacactttttgttccacaaattgcgacacagatctacctcgtagttaataagacaatgcttggttctatgacatcggttcaagctgcagggttctttgaccaatctgataaaatgattaaaattgttttggcaattgtgactgccacgggaactgtgatgttaccacatgttgccaatgcttttatgaaaggttaaattagtaaaacaaaagaatatttgtacagcagttttagatttgtaacaattgtttctattcccatgatgtttggtatgatggccattgcaaataagtttgtaccgttgtttttcacaagtagtttttccgctgtgggacctttgatgatgattgaatctttggttattcttttgatagcttggagtaacgcgttgggaactcaatatttattaccgacaaatcaaaataaagcatttacgacgtcggtaatactgggagcaattgtaaatatcataatcaatattccattgattttagtttggggtgcattaggagcaacaatcgcaacggtgttgtctgaattaacggttacgacatatcagctttatgcggtacgacgtcaaattgattttcggaaattgtttaaagagacacacaagtattttgtggctggactagttatgtttgtagtggtaaaacttattgatcttaaggctgcaaattcatggttaatgcttcttggggaagttttcataggtatggtagtttacttactacttttgcttattttgaaagttaccttaattagtgaactgaaaaaatcattgaagaattagtcagaatagtgtaagtattattcaaacagtagtgtgatcttaataaatgagttcaatcttatgatcatttgtgttttttgataatgaagttgatcactacccgtacattgatgaaaagtttaagattgcggaactttagtgaattttcaaggtcaaaagtttacaatggtactagatgttttacaggaggatacgcatgagacataaacagggacaaaaaaggcatacagtaagaaacgtgattttggtaattctattggttctaattgtttcggggggcgcttatgcagcgcgtaagttttataacttaaaacatgctgtggataacacctatcaaagtgctggaatcaataaaacacggaatgcaagttctgaaattcaaagtaagaaatctatctcaatcttgattatggggactgatactggcgcattgggacgttcgtataaaggccgcaccgatacaatgatgttgatcaccatgaatcctaagacggataaaacgaccatcacaagtattccgcgtgataccggcgtcacaattccaggatatgagagtgagtcaccttcgaagattaatgcggcatatgcgtttggaagtgctgggacagcaattaagacggttcaggaaatgttgaatgtgccaattgatttctatgccatcatgaatatgggtggtatggagaaggttgttaacgcggttgatggggtgacaattacaccgacacttagttttacttatgatggctatacgtttaagaagggccaagcaacgcatatgaatggcaagaaggccttggcttacgcgcggatgcgctatgatgatccacagggtgattatggccgtcagacgcgtcaacgagaagttatcatggctattatgagtaaggcggggtctgtgaagacgttattgaacaagaactttttggattcgatttcctcacaaactaaaactgatttgacgtttgatgatttggtagctcttgcgcaagattatcgtggtgcaaagaagacggtgtcccagacccatttacaaggaactggcaagacagttaatgggcaaagcatggagttgatggcaaagagtgagttacaacgtgtcacgaacttaaatcgaaagaatctcggcctggcacatgccacgactggtaacattgcattgagcgtttctgctacatctagttctgatagtagcgtgcagagtgataatgtgaatgcggggaattaaaaaaatattagatagttgagtagtgcaatgaaagttagaactaatgccttaaaatttagctctagctttttttaattgcttgagctttgtattactttggtgttatatgatgagtgccgttgaaaattatttttgtggggtttttaaatgttggaggaacaagttgagtaacagagaattagctatagtttcttggttgataattttgggcatgcttttcttagtgacgcggagctcgcgtaaactacttttaggatctttacatacattagcggatttgttatttcagccggcattcagattgattttatgttatcaaataattattttgagcgttctgagctggataatcattcagaattgcttatcttggtggattttaaaagattatctactggtttttttgacttcgatcgtaacgtttttgggaacttctaggctcacaaatttttggaatgcgttatctagcagttttggatttggcgaattcttcaaatttatattgggaaattacactttttcgtattggatagaaatgctacttgttttcttctttacagtgtttgtttttgttactgttgcaattcagtattctggaaaacatgagtaccgagagttgaataaagttagtaataacttgacaatgctaatcggcttcttattaattatattattttcatggcaactcattgcaaaatggcagctagaactacatttagtctattggataaatttttttattgcaccagttacatggacggtaaatttaccgttaattattctaactatcccattatttgaatatgataatatagatcaactctgtgtttttaaagtgacttctaggaatcttattgaacaagtacttgtttttttagtcatgagaataaaatttaacagactgcgtttccaaaaactagaaaacaacattatagaaacgcatcaaggaggggtcttgaatagaagaatgatcattattctgtgtgatgaaacttcagcagacaaagcaaagaaaattgaaatgtattataaattgatgtttgcagggggatcagtgtataaaaaaaataaaaaagtgatacccattagagttgaatgtaggaaagaatcgaatagagaattattaattcccccttatgaatgttctcagctaaaagaggaatataaaatgaaaaatttttaactaaacatttaaattagcaccatttacaaccgccctttacacttaagttgaataacaaactaccgcatagatttatttgtaaagtcttcagagcttatcttctgaggctattttttcgcacagtgtaaagtcgaacagggtcatcaagtagaaaccgagcattaagccaagttcagtatgaataaaattcatgacggctcgacaatcgtaaattagttgaactggctatttggtgaataatgagattattggtgcaacaatcggcagtaaattttattgatattcgtgcgattaatatttagtttcctgattttgtgaggggaacgtatgtgctataatagttacattaaaagtaaatgccaattattttttgagagggaatgcaatttgaataaatatactagtagttctaaagcaatcgatagtatgagtaaacaaattcggcaagccataacgagagcatcaacattatcttcaatcaacaaggcaagtgaaagtattcgttctgatggtggattagtttctcttgattggatcaataatgtacagcgaaatatgcaacttatgtcatctattcagaagtcaataacagcaaatgccctgccacagttttcagctttgaatctctcaaatcaagcaatacaaaaagattcaaagattatggaaagaaatgttgaacgaactgccaagatgattagctccgcagaacaaggtctaaacataagtaaagctgttatgggtaatttatcagattcatttaaaattatatctgaaagacaaatgagcacattaaaaataataaatgcgtcagcggacctagtgaagattataagtgcgcagatgcctaaaatgagtacatacgattttagtgatcttgcaaaagtaacttcatctgccacaaaagcgtttaatgaggccatgaaaaccgaacaaggccttaaaaatacaattaaaggcttaaatgatatacctagggctgaattttatgatgaattttttgatttggatcctgaattaacagaagatggggatgaaccaaatgtttcagctgatcagaaaaccgtaaatgaagttaaagaggcaatgacaaccgggagaaccgagaagctgtcaattgtcgcagcaaaagtgtttcgaatggttctaagatatatcgggctaagaataacagtgctaatactaatgaatacaccgactggacaatcagtttatcaatgggaacaagtggatcttggtaaccaagaagatgcattaattgaatgaaacggatggaatccaaaagttcccaaaaatccgtacagagaagtaaagattgaagggttggcattaagaatgcgaccgaaacataatgcaaaaatccagtctgttttgaaaaagagcgaaatagtcaaaataacgcaaacaaaacgtaactggaaaagagtcgtagttgcaagggaggatggaagcaaggtgtttggctggacaaacacgacatacttaaagattgtgaaagtacgatgaagcaaaaaaattcagaaaatttaaattggtaaaatttttccgaatgtagctttcattatgaagtggtttttgaattttggtaggagtagatttgaatttatttcgtgaatttattttctcaatattaccaataaatatggttcatacagaatgagtgagaaccatcctttagaagggttactaaaattagcctatattgatcaactttcaaaggatttcggaattgatgataactgtaatgaggatatatagcaatagttgatataagaataaaaaaactttttacaaggaatgaatttgcgcagacaacgctaaaaaaattgttataattatgattgaagagcatttggtaacgggggataaaaatgactaaatatgacgaagaagcactcactgatgaagatgtggagtacctaattcatacattaaagcatccaactcgagagtttggcttggatgaattaagaaaaaagattgaaaaccccattactttggataatactgagattgatggaaatgctgtaattttaggagtggtggataatatagaatacattttacacgtttattgcggtgatcctgttttgcctaaacctaaatattcagtccatttgcgatttaaaaaatctaacattcagttagttcgagtggatattgggggaagacatacaaacccaggtgaaaaggtggctaaggcttatccacatattcatatttataatccaaattatagtaagaaagacaaagttgcctatcgcgttaatacagaggattttccgaatattcataatatcatggtaacttttgaaaatttcttaaaattcacaaatattcatgatcaaagcgtatagaaaggagtggataagaatggcgtatgattttaatgcaagcacattaaaaagtgaatattttgattggttaaatgaacaagagtcatttaatgatgtgggttccattagtcatcctgttgtagaaattcaaacaccattccttgatcaactttttgatggtattgatctttatatttatccatctggtattaatcaagttatgattacagacaatggttatactttggatgggcttgaaacaaatggtattgtgtttgataaaagaacaaaaacaagaaataagatcttggaggatgtgttagattcttttggaattgaaagaaaggtaaactcaaagaaactttttattatctcgagaagagatgagtttccgaatgcaaagcagagattacttcaaggtattttaaagataattgatttaaattatacagaatcaactaatgttattaatttatttgcggatacagtggctgatgttttctctaagcaaggcattttgtttaatcgttcccgagctgtggttgcgcctaatggtcgttcgtttgtatttgattttatgatcccaactaagaaaaaaggggataccttggtgagaacattccatagtcctcaatttacaaattctgcaaaagtttactcatgggatgcaagttttattaataaatactctgcgaataaacctggaaagtttctggctgtaattgacgataagaatgccaataaggaccaggttgatagttttaatgaaattctaaacgctgatgagcaggctgttgtccaagggattactttttcaaatattaacgaacaaattgacttatttttgaattaagtaaaaatgattgaatatgtaaaatctagcgaattagaaaaaataggccttcagaacttacccttctgaaggtcacttttttcggattgtaataagaagttgaatggggtcatcaagtaaaagccaatcattacgccgagtccattatggacaacatccatgatatctactgttcgactaatgtggactagctgatctaatacgaattgaccaccttcgttgaataaggcaattcctaaggcaatgaagaagacttcaaagaggattggtcgatctctgtaggcaaaaatataaagatagaccccagcaggaatcgtcatgatcacgtttaagatggattgggcactataatcttgataaggcatggcaaccactttagcatagccaatatggtaggtatgcagtaaataggtttccccaaatgagtaggagccgggggtgaagatcaggtagagcacacagatcacgtagatggtgaaggtggttctgactaaaatagaaaatccggacttattcagcatcatttttctgagattgtagattgccacaagtgctgaaattattacaaacggtaaatactgaatggctgccattgaaccacctccaaaattatttaatgtttccattgtatcgcaaaacttatcatattaaaaccgataataccgcggtttttagttaacttttccttaacaccgtagaactttcttaaactcctcaaaaaaacattgcaatcgaattcagaatgatatatgatgagcttgtaaagaaaatgtaatattaatgtaacactttggaggcggttttgatgaaaaaagtaattcgatttttactaatagtaagtttggcaatgggtgtatttatgattggtaatacgacacaaactcaggccgcttctcgaagaacaattccagttgccatgcgaggtaattggtatttaacgaagaaaacgggtttaagtgtaaaaaagacatcaatggttggtctacaccatactgtgatggagagaacatacggcaagtatatggtcttcaaatattactataaaggtagttattcattatctgatacacgttggggatttggattcttcttcaaattggttaatgtgaagggtaagaacggtaaaaactataaggcattggcgatgtggggccagggaccagaagcccaactctactataagaagttgaataaaaacgagcgtcacagcttatcatggcgcaaaacaattaaattgatgaatggacaaaagaatttctagcgtctgactttacctaatgagggaaaggctttataatgctaaagagagtgcttcaaagggtggctagcttccgagtatagcctaggtaaggtaatgattcgggtttggaatcgttagcttaccgtagctaaacggaggaagttgccctttgaagcacgtttacgctatacagcagagtagggattaccagaaaggatgttacaattggaaaaaaatgaagaagaaccagtaaaaaagccatttgatattggcgataaggtccacgtaaagaaaaccgctttattaccaacaggctttgatggccaagtgggtaaggtttatgaaaattcaattttaattgatatcgatccagatactgttgctaaaagccgcagtgaagagcttcatgatttacatggacgtgtcattgtccgttttgctgaagctaagaagattgaagcttagtcaaaattaaaagttagaaaagcagtcatatcagccgatgtggctgtttttgcttgccatgatttaatgttattcataattttcacagttttacctgttatttttaatattcatttaattatcttgttgacaaagccctgttcagagtgtatatttgtcattaaattctgattagacaatttctcataatcagatttaaatattataggggagttgtttagcgtatgaaattaaaaaagggatcagtgacacttttagtggcattacctttactattactagcagcttgtggtaatggtaattcatcttcaaagagtaacggggcagtagataaaaataatttagcttcaaaacaggttgtgaactggacagagacatcggagttgccttcgattgatccttcaatcgcaactgatcaaattagttttgatactatgaacaacgttggtgaaggtttgattcgtttaggtaaaaacaacaaaatcttacctggaattgcaaccaagaccaaagtttctaaagatgggaagacttacacgtttactttacggaagaatgctaagtggagtaatggcgataaagtgactgccaaagatttcgtttattcatggcaacgcatcaataatccaaagactggggcccaatatgcttacttatatagtggcattaagaatgctgacaagatccaagccggcaagaaaccagtcagcagtttaggaattaaggctgatggcgactataagttgactgttacccttgaaaaggctattccatatttcaaattgttaatgggcttcccaagtttcttcccacaaaatcaaaaagtggttgaaaaatacggtagcaaatacgccacacaaagtaagtaccaagtttatgacggaccatttacgttacaaggttggacagggactaacaacaagtggacccttgttaaaaacaaaaattactgggataagaagcacgtttacttatctaagttaaatgatcaagttgtgaaggatacgcaaactggtttgaaccttttccaaggcaaacaagttgaccaaactgttttgtctggaacccaggttgctaacatgaagaacagcaaatccttcttccttggccgtgaagctcgtaattcatatcttgaatacaactacaaaaagatcaaagcctttcaaaatgtgaatattcgtaaagcaatgtctcttgctattaaccgtaaacagttagttactaacgttttggctgatggttcaactgcaccaaagggatttgtcaccgatgggttggcaagtaaccctaagactggtgaagactttgcaaaagaagcttacaatggcgaaggtgttaactacgacttagctaaagcgaagaagttatgggcaaaaggtttgaaacaagaaggcaagaagagtgtcacatacactttgatgtccgatgatactgaagccggcaagaagactgctgaattcttacaaagtcagttagataagttgcctggtttgaagatcgatgttcaaaccattccatacaagacgcgtttggcacgttccgctaagggacagttccagttggttatcacaaactggggtgctgacttctcagatccaatttctgatttaggcttgttcacatctgacaacagctttaataacggtcgttgggcaaacaaagaatatgacaagttgatcgataaggctaacaatgccgacgctaacaacactcaaaaacgttgggaagacatggttaaagctgaaaagatcttgatgagcgaacaaggtaatgcaccactttacaatggtgttgttcctcaattaatcaatacaaaagttaaaggctatgtatacaatactgctggtgttccttggaactggaagggtgtttacgtagaaaaatagtttcatattaaagattcagaagattgcacagattcagtgcaattgttctgaatctttttattttgcgtcatacaagccgcaatttttgacttttaatcaggagcttggtaggctctactcagggtagtcaatggtgtgaattatttgaaaatgtttgcaatttgtgacagttcaaatttgcttgtcacgaagtagttaagccgaagaacccggtaaataggcaatcgggaaaaatcatgagcaacgatgtcgttaagtttcgatcagcaggggtatactttgaacacttacttaatctgggaggaaagaaattgacgaaaattgcgattgtgaccgacagtactgcctacttacctcaaaacgtttgcgagaagctgcatattatggtggctccaatttcggtaggttttggcgcgcaacagtatcgcgaacggattgacattacggatgctgaattctataagcgtttaaaaagtgaaaaaaattttccaacaacggcaccgccatctatgggcgcaatgaatgacatttaccaggctttggcaaaaaaaggctatgatgaagttgtgagcatccatctagcaagcggtgttagtggctttgtgaataatcttcatcaatttgctgaaagtgtttcaaagattaaggtccacgttgttgattcacaactttcagtgcagccaatgggatatttggtggtccaggctgctaagatggcgttggcacagaagtcagcaacagaaatcatagccaaaatgacggagttgaaggccacacttggtgagtatttcattgtggacgatcttaagaatctggtgcatggcgggcgtttgggaagtggctctgcgtttgtcggttcacttctaaaagtcaaaccaatacttactttgaataaagagcgttataatattgaggccgtcgacaaagtgcgttcaatgaaaaaagctaaattaaacattgttaatcgatttattgaagaaacaaaggatctgtcgtataacgtgcgcgtgtttttaagtggaactgataacgaacctgttgtggaaaagtggcgggaaagtattcagtccaaattgagcaacgtggcggcaattgagacaggacaaattggcccggttctgggcgctcatcttggacccggagcattggctattttatgggtcaaggaagtcaattaggacatgtaaaagtgaggtagtgaaaatctatgaagaaattaaaaattgatttaaacgatcaagattatatgggcagtcatgaagcaagttccatgtggggtaagcaaaaagattatgtccgaacaatctataataagtatccaaaacgttttcctgagggtagtatccgcaagttcggcaaacaactgattgtgacccgtgaaggcatggaagctgtcactggcattaagaaaagtcagttaaaagatcttaagaaaaacaagtaattaaaaatcgctaaagtgtaagttgaccggacgaatgaattcggtggactggactttagcgatttttgtttggccaaatgctgatatgatagaatcaacttgtaaagttaaggagaaaactatgaaaactagtgaatttataaaaaagttggaagtattagatttaactgaagttgaaaaagactataaccagttacgggtcatcagacacggcgaagaagcggccactatcagtctcacggaatcgtctgattttcgaatttgtggcaaaatgccacgacgattgttgaacttgattgtggattatgcggtcacaaagattgaggaacgtaaataaggatatattttgttagcaaggttcaacaaaatagttatcagtttgaagagaattgcaacaataaatttggttgatatcatgctttcaagcaatttggtatcttatttgaagttgacgataatataatcgctaacacaaagatacaaaattactcattacgccatacaaagaagtcctcacatttctgaaagcatgtgaggacttttgctgtgtaaaaaaactttatgttaatcaaaaggatgtccccggtgagacttgaactcacaacctatcgcttaggaggcgattgctctatccagttgagccacgaggacctgttacctttcgtattttcccataaaattagtggataatcaaggtaacccaaattgaaaaagtgattttctgagcttttttgagtttaatcgacaaaacttgatcgcaatcaatttcaaacttgtcttttgcggctatattagacttatcaaataaaggcaaggggataaaaagatcatgatgaaattcgaacaagttgttcaaaaaaatgtgaatgctattacgtggacatcagctgcattaattgtaatcggctttttaggggagacaatggggctacaactagtttatacagttgcatttgttctagcttccatcatagccgcaacgccgatcattattcgcgctgtggaagctttaaaagttcgtgtgattggcattgaattattagtcagcattgcagtcgtaggggcttttgtcattcaggaattcaatgaatctgccattgtgactttcttatttttgttcggcagtttcttggaagctaagacattggctaaaacgcgagaatcaatcaaaacgttgaccgaaatggcaccgacaactgctgaggtggttcaagcagatggttcaattgaagaaacggatgtcgatgatgtcgatgaaggcgatattgttttagtgaaaacaggcggtcaggtcccaattgatggcgatattgttgaaggctcgggctacttaaacgaagcaagtgtcaccggagaatccaaactggttagcaagcaagaatctgacagtgtttattctggaactattttagataacggaaccttaaaagtgaaagccaccaaagttggcgatgataccacgtttgccaagattgtggaattagtcgaagatgctcaagatacgaaatctcatgcagagaaatttatcgatcaatttgcgaagtactatacgccagccgttttgattttagctttattagtgggcttcatttcacgagattttcgtttagccatcacggttctggtacttggatgccctggagccctagtcattggtgcgccggtatccaacgtagccgggattggaaatggtgctaaaaatggggtgcttattaagggtggcgaggttgtagacacctttgccaaaatagataccttagtctttgataaaaccggaactttaacgaaagggcacacagaggtttcggatatgaagagctatacgccagaacaatcccaagcattggcttatgccgccaaacttgaaagtcaatcggatcatcctttaggcaaggcgatcactacttatgccaaaaagaatcaaattgcgtttcaagatttgcaagttacagaaaataatacaatcaagggtcaaggaattgaagcacagattgaaggccatcagattttggtgggaaatcagaaattattaaccagtcagcaactcgaattaagtgcgcaagaagttagtgatttgcaggccttacaagctactggaagttctacggtgattgtggctgtagaccgtcaggtgcagttaatcattggggtttcagatgtgattcgcgataatgttaaggaaaacttggccgcgttaaagcaacttggcatcaagaaattagtaatgttgactggtgataacgaaatcaccgcaaaacacgtagccactcagttaggcattgatgaagtgcatgctaacttacttcctgaaaacaaggttacctttgtgaaacaactcaaagatgcgggccataaagtagcatttgtgggtgacggtattaacgatagcccttcaattgcgaccgcagatattggtattgcgatgggtggtggaacggatgtcgcgatcgaaacctctgacattgttctaatgcagtccagtttccaagaactcgtccatgcttatgggctagctaagaagacagttgccaatacacgtcaaaatattacgattgcgattggtacagttatctttttgctaattggtttgattttcgggtatatttatatggcaagtgggatgtttgtgcatgaagccagtatcttagtggttattttcaatgcgatgcgcctcattcgttaccgtgcacttaccgaaaaataaatcaaaaagagttatcaaaacttgatcggcatcaatttttaattaacaaagccacgttatactttaagcatagcaattaggaaaaagctttttgctaaaaaaaattaggaggtttttaaaatgacaaaagcaggtttacaattaggtgcattaacttgcccatcatgtatgcaaaagattcagggtgcgttggaaaaacaagctggggttcaaaaggttaaggttctgttcaacgctagcaaggtgaaactcgaatttgatgacagtgccaataccgctgatgcgttagctgaagttgttaaaaaacttggctatgaggtcaaaagtgttaaggttaaacagccagccgaataaaaaactaaaataagcttcatcctgctaattaagaactacaggatgaagctttttgtagcgtactagtatcaattttagtgtggattatgctaatcacagatgagtgatgtcacgctggcgcctattgaaaacgatcattttgcgtggtatagtactttagtaattaaaaacgaaatgcatatataaacgccataataaggatggcgagtttctacccagaaccgtaaattctggactatacgcaataaactcatcaaacgatgtctatttgcggacatcgtttttgttttactgtgatatggatatatgcctaggaggcaatgagttggtttcaaaagaagaatgggcacaagagcagcttgatttcgacgcaggagagggtgttccacaggaaaattcaacgtcaacggcgcatgccgcagttttagggttgcagcatttattgacgatgtactctggagatgtcatggtgcctctcttgatcggggcgattgtacattttacagctacccagatggcactattgatttcaatggatttattcatgtgtggggttgccacgttgctgcaagttcaccgaacacgcttagttgggattgggttgcctgtcgttttaggatgcgcggttcaagtgattaccccacttgggacaatcggtaaagatcttggtatcacaacgatgtatggggctattattatttccggattatttgttttattgatgagcggaattttttcgaaaatgcgcaaactttttccgccggttgtgaccgggtctttaattattgtcattggtttcaccttgatgcccgtcgcaattactgatttaggcggaggaactgttagtgcccataactttgggtcattcaataatttattggttggcggttttactttagcggtgatcattgcggttaacgtttggggaagaggatttgtgcggtccattgccgttttaattggtttagtggccgggacggccttatcaggtgctttagggatgatcaagttaagcactgtctcccaaagtggttggttccgttttccagaacccttcatgtttggagtaccacactttgagtggtcttcgtccgttaccatgatcttaattgctttgactaccatgattgagtcgaccggtgtgttctttgccttgggtgatatgaccaatcgccatttaaccggcgatgatttaaaacggggctatcgcgctgaaggaattgcccaaattttgggtggcatctttaacactttcccatactctacattctctgaaaatgtgggtgttgtgcagttttccggagttaaaactcggaagccaatttactttgctggcttattcttactgattttaggcttattgcccaaaatcggcgcattagccacggtggtgccaacaccagttttaggcggggcaatgttagttatgtttggaacggttgggctacaaggggtccgaattttgaaaaacgtagactttgatgacagccgcaatttgattgttgctgcagtttccattggcgctggcttaggggttgccagtgtgcccacgattttccaagcgcttccttcagaattgtatttaattctcggtaacggggtcgtcgtgactagtattgtggccgttttcctaaacttggtctttaagttacaacgtaaaactgaagctaaataaaaatgcgcgaatttcgagtctgtataaaacagatcaaagaaattcgcgtatttattttatggaaggtgaaggtggtttatccagttaccgtttctaaaaattggggtgatggtgccatcttgtttgatgccatcgatgttcattttgtcagaactgaccatgaagtcgacgtgcacttggctattattgatgccatgtttggacaattcttcaggagacgttttagcgctgccctgcaagttgaagcggttgactgggttagaagtttacacccacctgagtaactaaattagcgtatttttgaagctttttagttaaagttgtttcatttataaaggcaatcctcttcataaaaatcgattctatcgtagcatagccaacgcgtttccacgcaagaaatgggcggttgattgcaaaataagtgctaagaaatatcagaaagaccagttaagacttaaaaaacgatgagtggtgcggtatacttgtttgcaagagaaattattaattatgccgataaaggcaccttttacggaggattattttgaaaaaattacgtgtcatgaccatatttggaacgcgtcctgaagccatcaaaatggccccaatcattttagaaatgaatcaacgaaaatctgaatttgaagcgatcaccgttgtgacagcgcaacatcgagaaatgttggaccaagttttagaaattttcaaaattaccccagattatgatttaaatattatgaaacccaatcaaacgttaagtgagattaccggccgcgttttaaataaattggataccattattcaagaagtgaaaccggatgttattttggttcacggagataccacaacaacctttgcggccagcattagtgcgttttacaaccaaatcccgctaggccatgtggaagcgggcttacggacgtgggataagtattcgccatatccagaagagatgaaccggcaattaacggatgttttggccgactattactttgcaccaacgactttaagtaaacaaaatttacttaaggaaaaccatcccgaagccaacattgcggttacgggaaatactgccattgatgccctgcatgaaaccgtgcgtgaagattatcatcacgctgtgctagatttggtaatgccagagcatcgtctaattttgttaacgatgcatcgccgcgaaaatcagggagcaccaatgcgccgagtatttaaggccattaagcaagtcgtggattctcatgcagatgtagaaattatttatcctgttcatctaagtcctgccgttcaaaaagcagctcacgaagaactaggcgatgattcccggattcatttgattgacccactggatgtggtggatttccataatttgtctgcgcgcagctatttcatcatgacagattctggcggtgtgcaagaagaggctccttcgttgggcaaacctgttttggtattgcgtgatgaaacggaacgtccagaaggggtcacagctggcacgttaaaattggtgggtactgatccacaaacagtgacggatgcgatgctggaattgttggacgattcacaagtttatcaaaaaatggccactgccaaaaatccgtatggggatggacatgctgcccaacatattttagatttcttacaacaaaaatttagtgataagcggagttaatggggatgaaggatttaattaaaaagaatcaagccatcattttgtatttagtttttggggttcttacaacagttgtcaatattggggtgtttgccttttttgaaacttatacaaattggaattaccaaattggcactgcaatcgcgtggattgcatcggttttggtggcgttttttactaataaagtatgggtttttagctcaggttacactacctggcgggcgttttggcgtgaacttggttcctttttcttctttcgcttattgacctactttatggaagttatcattatgtgggttggcgtttcgttaatgaaggataatgccattttagtaaaagtggctgataatgtgatcgtggtgatcgtaaattacgtgttcagcaaattaattatttttaaacaacacgagacaaaaaaagattgaaactgattaaccaaattccaatcttttttaaacaggctttagttctgtgaggcattgtagctatcaactaagcttttggcaaaggcatctaattgatctaaatcttcttctgattcaggtgccaaattgattttaacgggttctgctccttgtttagctttagcagctttgaaagctttggcaaaggcatcaacagcgacacaataaaattcttcataaaaaacgtcgccggatccagctacgccaaagattttaccatctaaatctaaatcaggtagttcttcatagaagtccaagccttcttcaggaagggcaccttcgtcgtaggtgtaaggtaccacaacacagatatcaaaatttttaaattcatcggcatcggtctgtgaaatctctgattcgtcaacttcgacgccgagatcttcaagcgcttcggtaatgatgtcggcgcaatcttcgttgttgccggtaatggttgcaaaaacaacttttgcagttggcatgtgagttcctcttttcattataagtcctaaagaattatagcagacaaatccagtttagtgaatgttttcagcaaggaggttcacgatgacagaaaaaaaagcagttccaaaggtaaccaaaattaccacgcaaaaaagagaaggacgttataatgtctttttagatgaccaatacgcctttccgattagtgaagatgtgatgattaaatatcgcattttcaaagggatggaaattgataagcaattgcaagaagaaatcttggcagcagatgatgtttccaaggcttattcacgcgcattggcgtttttgtcaggccacttacgaacggaaaaagaaattcagcaaaagcttcgggaaaaagaaattccagaacccacgattgaagcaactttgaaaaaattacgggaattaaatttagtggatgatcttcagtatgcccaaagctacgtgcgaacgatggctcggacttctgataagggccccatagtgattacccgcaacttgcgaaccaagggtattttagaaaatgacatcgagcaggcgttattagaatatccggcagatgatcaggtcgctaacgggattgaaattggcgagaaacttagtcaccattaccgccgggatccggtttcgaagatgaaacaaaaagtgcggcaaggattgatgaccaagggatttacaggagatgtgattactcaaattcttgaacaaatggaatttgaaattgaccctgacttggaagacgagaaattgaaaagtgaatttgaaaaagtttggaatcgtaatcgccgctatgctttttcacaacggaagatgcgcacgaggcgaaccttatatgggaaaggtttccagtcggacgccattaatcgattaattgacgaacaagaagatttaaaataagtatcatcgttttatgggggagcaatagttatgaaaaaacgtttatggcgggttattttgtttggatttattttaatgattctgattggaagcgccgggtttggttatcacaattatcgcgtgatgcaacgtagtgatcccatcttttttagtggctcaacgaagcatataccagcacgaaaactagtaccaaaaacctttgttccacgcaaagtggtgacccaacagccgaagttatcgctaaaggctaaaaagttaaagcagttgctggaacctttaattggtggcgaccagtttgtgggcacgatcttaattgtgaaaaatggccaacctatttatgatcaaggctatgggtatgctaattttcaaaaacaaggatttaatacggcacaatctgaatatcaaattttatcgatgcaaaaatcaatgaccgcgactttattaatgcaacaggtggaagcaggtagattgaggttgacagaccgactggcccaattctatccaaatattccaggtgctaaaaaaatgacgattcgatctatgcttaatatgacgaccggattacgaattcacaatttttccacccgttcactttccggttccggggtggtagattatgcagctcaccatgtgcaattcttaccaaatcggaatcacaagtggtcgtatcagcctgttaattacacgttattagcgggagttttgcagagggtgacccatcggacttactatcaattatttaatcaacacattatccggttactggacctgcatcattcaggctttgtcatgttagcaaaacgagcaaattggttgtccacgccgtatcataatcaaccattttctgatgattctgctaattatttacatgcgtttcacgagtcaccagctaatcagcataatgagttggcaacaggaaatgtctatatgaatgcgagtgatttttataaggttagtcgtgcaattttgcaggctagatttgtgagtgttgaaaatacgcagattttgcatgatgcagcaggtaatcggaaaggctatgcgggcggtttgtatcacgaaaaaaatggcggttattggagtcacggcgttggttatggtgaagaaagcggcatgatgattagcggcgacggacaaaatgcggtgattatgttgagtaattatcggcggaaagattcaatgttgaagcagcaatgtcatcagatctatcaaaacttgatgcaaggcatgtattaaatgattaagttagaagtgatttaggaaaacaatctttttattgtagactaattttgagtggcggagatccgtttttggttagaggcgaaaaattagcctcgaaacgaccggcatagttttattaccttagaatgggacaatactacatcaagaatagtgaaaccactttgaatcgatattgatcaaaatttatttttatgaccagcactcgttctttcgtctgctggtcttttttgatataataatggatggaattctaagagttaaaaccttcagaattagaaagctgtgtcatagaatgaatcgcaagtctaagaagcctagagcaggggactatattgcgatcaaaagctataagcacgatggcagtttgcatcggacgtggcgggatacaatggtattaaagaatagcgatgatgagtttattggttgtaacgaccatacgcttgtgattgaagatgatgggagacgatgggtaactcgcgagccagccatagtttattttcataaagattattggtttaacgtggtgaccatgattcgcagaaacggcgtatcaaactattgcaatttggcttctccatatgtattggatgaagaagcacttaaatatgttgattacgatttagatgtaaaagtctatccgaatggggatcgaaagctattagatgttgatgaatacgaacggtttagccggaagtggcactatccaaaagatacagaccaaattgtgcgttcgagcgtcattacactgaccgattggattgatcaggggattggaccgttttcaaacgaatttattaatatctggtaccatcgttatctagaacttgttcaacggaataaccggcgttaattttgatcgtaagagaaattgaaccaattaattcgatttcaggtctacctatataaatatgactggcaatgtttgaaaagttcaaatgttgtcagtttgtttttataaaacaaaaaattgccacttttttaaatttactgttcttgtaatgcaaaggttatgaaaaatgatgtcttaataggctataatagaaacgttatggaatggaaaacaagtttatgtaatgactagttttcacagagagaaaaaggagccatgctatgtttgataagattaggcgatcccccttgatgttttggaccttggagttgctgatcgtagcgactttaatttatgtttgtaccaaaattaattttttgtttgcgccgattggaactttcatttcaaccgtgtttgtgccaatccttttgtccggatttttgttttatttacttaatccgttagttaaattgattcaaaaaattaagtacaaaaagtttcgtattagccatacctgggccgtggtgattgtgtttgttctgttgctgggaattattgggtatacattgggatggatgattccaagattggccaatcagattgcgcagttgattgaaagtttaccaagtattgccagcaatttacaaaaggcctcacagcatttcttggaacattccgattggattaaaaacgtagacttagatccctacattaagaaaatgaatagttcaattggaacctatgcagagtcaatcttaagcacaatgacgagtagcattggcacgttaatcgccacgattacaagtgtcacagttgtgatcattacggtgccggtaatgctattttacatgttaaaagacggctggaagttaatgccctccatcaaacgaatgttaccagcaaaaaatgcagatacgattgtggaattgtttgataaaatgagtgccacgttatcctcatacattggtggacaggttttggaatgcttgtttgtggggacgtttaccgcaattggttatatgataattggtcagccttatgcgttgttattaggtgtcgtagctgggattgcaaacattgtgccctatgttggtccgtatattggaatttttccagcgttgctagttgctctgacggattccacgatgcaagttgtttgggtggttatcgtcgttttgattgtgcaacaagtggatggtaatttgatttatcccaatattattggtcggagtttgcaagtacatccactaaccattattattctgttgttggcggctggaaaaattgcgggaattcctggaatgatcttggcaattcctgcctatgctgttgtcaaagtattagttgaatttatttatcatatttggatcttaaacaatcaagattagtttaagttagttttgattaactaggataacgctaatttactggaatgcggcagcttgtttgtggtaatattgatgagtatttaatattatattcttaggagaatgaacattgaaaaatgtaattacttatggcacttttgatttaattcataagggacatattcgtttacttaaacgtgcaaaggcattgggcgaccacttaaccgtgtgtgtctcaacggatgagtttaatgcgttaaaagggaaaaaggcttataccagttacgaagatcgcaagtacattttggaagctatccgttatgtggatgaagttattccagaaaagggttgggatcaaaaaatcaaagatgtccaagaaagacacattgacacttttgtgatgggcgatgattggaaaggtaagtttgacttcctgaaagattattgtgaagtggtttatttaccacgaacagaaggtatttcaacgactaaaatcaaacgtgatcttggtctagcaagcgacaataaaaagtaaaagtaaacaaaaactgggggtaatccctcagttttttcttatatatgatattaaattaaatttttttaatgattagattggtaagaggattgatgatgaaaaaagccttagttctggtttcggatgctgtttcgataaagaatccgtacctgataaaaacgattaaaaaattagtgaataatcaaattcgggtgacagttttggtcatgattttggactatcatttggcagccaaagtcacttttaaattgaccaaggctgttgcaagggaaaattctgaagcaaaaattatcaattggtttgatttattacatgaacaaaaggggattgctgtcagcttgcaaacgctagatacaattcactctggtgaaccggaaaaacggacttttgaacttcctgaacatgaaaagatcgaaaggtattttgataaacatgacctcatcatggaacggatttttagacaagacagattggcgcttcttaaaagctttgcggatggtacgttacaaacgcaatactattatgatgaccaacaaagagttcgagaagttgtccattttcaagatggacagccaacaatttatgaagttttgaataacactaaccaacaactttaccaattcattgtcaaacagccacggcttagaaattatagagtggcaagtgatagtgaatttgcggcgcgtggcgcgattgtggaatcagatttgtttaagggcacgccagggaataccgtacgctttgaaatctcaaattctcaatttagtgtccatgactatgtgacttggcgtccttataaaaatgtatttgaattttatgcagggcaattacgtcagctaattgataatgatcagacaaccgggatttttatagatttagaattggttgaatccatgagtccttatttgggcaccttaaaaacttttaattattgagaaagggggcagcattaatgcgcgcaattttgtccgatgtgcagactaggtctcaagaacaagaatacgaaattgaattaatcgggttaacacagcaagttaaaaacttgcggctattttttattgagcaggaatccttagaaagcttcatgatcagccatgtcagaattgacagaaatatgctgcagtttcagctaccttctgggcaattgacaggtagttttccgggacagaatcggttcacttgggaaatgtatttacagtggcaagaaggcgatcattttgaaacggttcaggttgaaaatgagtttgtggacaataaatggttggacattaacttgtttcaaaagtttcagacagattttgctggttacgtgaatatcgaagtttatcgcaaaactaatgatgatctgtttgagttgcaaaatgtgcaacacgtgcctgatgggatcatgctttttggcactaaacagattaatgtgcagagtttacaaaacattgtagttacagttaaaaataaaaatgatgagacagatatgctgcggattactgaaaatttaagtcagtatccagacctatttcagtttaaaattccatttgcccaattgacgattgctaatgaatatgagctggcaattacttatgattttaacgataaatattttcatcaacgccttggtgtcgcgagtcaatttaatcctgatagtgattttattcaaaatgtaaatggcaatgttgttgagttggatttggcatatgatagtaggctgactttggtcttgccaattgaaaagccatcaatgcaacaaccggttaaacggatcgcaggaaaagcacagctaactttaggcttagcgggcgtttttctcggtaaaataaggttgcatctgattaaacaattatttaagcggagccgaataccatatcaacggccaacagttgtgtttgaaagctttggtggccgccaggtttctgatagtccacttgccatttatcgcgtttttaagcagttctatccaggttataatttggtgtggtcgatttatccggaactcaaaagcttttgtcgagatcacgggatgcactatgttgtccgtgatagtgtaaaatgggtatcagtgatgcgtcgtgcgcaaagttgggttagtaatgcccgttatccatcatgggtaaaaaaatctaaattcaccttttatctgcagacgtggcatgggacaccattgaaaaaattaggtctggatattaaacaggtgacgatgcctggaacggatactgtgtcttatcatcggaacttcactcgagaagcaaatcgatgggatgcattgattagtcccaatgattattcaaccaatatttttcgatcagcatttggctataagaatcaagttttaaaaatcggttatccgcgtaatgatgagttaattaacacgacggcggcacaaatcaaggacttgaaagaaaaaatgggaattccagccgataagaaggtcgttttgtacgcaccaacttatcgagataatgcgtttatcacgactgggaaatacacatttaaattaccatttagtttgaagaaattccaagaaaagtacgggaaagatacgattttgattttgcggatgcactatttgattgcgaatcaaatcgacgtctcagaatttcaagattgtgttttaaatctttctgattatcctaatatcagtgatttgtatttagtttctgatttattgatcactgattactcctcagttttctttgattttgcatacttaaaacggccaatcttgttttatccgtatgactatgagatgtacaaaaatgaattgcgaggtttctatttggattatgaacatgagcttccgggcgaaattgtccattcggaagcagacatgtttaccgagataggaaaaatattgcaaaacggggatatgaccaataatgtccgtttccagcaattctacgaccgtttttgtgcaattgatagtggagactcatcgcgaaaagtagtagattatattgtaaacgcaattaagaagtaggaaggtagttatgaacgaaacaaaaatagatcaagcagtcgcaaaacggcgaacgtttgccattatttctcatccggatgctggtaaaacaacgattacggaacaattattgctttttggaggagttgttcgtgaagctggaaccgttaaagcccgaaaatctggtaattatgcaaagtcagattggatggaaattgaaaagaaacgtggaatctcagtaactagttcggttatgcagtttgattaccaaggaaaacgaatcaatattctggatacgccaggacatgaggatttttccgaagatacgtatcgaactttaatggccgtggattccgctgtcatggttattgattctgcaaagggaattgagccccaaaccaagaagttgttccaaatttgtaaaatgagggggattcccatttttacatttatgaataaactggatcgagatggccgtgagcctttagatttggttaatgaattagaagaagtgttgggaattgatgcttatccaatgaactggccaattggcatgggtaaaggactacaaggattgtatgatcgctataaccagcgagtggttctatatcgtaaagatgcacagggtaatcagtatttgccactggatgcggaaggtaaactctcagataaatatccactgactgaagatagtgcttatcaagatgctgaaggcgatatggagctacttagtgaagccggcaattcatttgatgaggccaaaattttatccggagatttaacgcctgttttctttggttcggcgttagctaattttggggttaaaactttttttgacagttatttgaagtatgcgccagctcccgcagctcatgtggatcaagctgaagaaaaaatcgaaccagatgatcccgagttttcaggtttcatttttaaaattcaagccaacatgaaccccaatcaccgggatcgaattgcttttgtcagaatttgttcaggggaatttgatcgggggatggatgtgaccttacatcgaactggaaaggtgattcgtctttcaaattcaacccagtttatggctgatgcacggcatacagttgaaaaggcggttgctggcgatattgtcgggctatacgatactggaaatttccaaattggtgataccatttattcaggaaaacatgacgtgcagtttgaaaaattaccacaatttacaccagaactatttgtgcatgttgctgcaaaaaatgtaatgaagcaaaaatctttccataaagggattcaacagctggttcaagaaggggctgttcagctctacacaaattataatacgggtgattatattttgggtgcggttggtcaacttcagtttgaagttttccaattccggatgttaaacgaataccattcagaagttgttatggaaccaatgggcaagaaaattgctcgctggatcgatccggaacaactggacgagcggatgtcttcttcacggaatcttttggtaaaggaccgtatggatcagccattgttcttatttgaaaatgaatttgcagaacgttggtttaaaggtaagtatccaaaaattaagttaaccgctaagctgtaatttaagttgttttataagggcaaatccaatttataacttggaatttgcccttttttgcgattcgtttttggtaattggaatttaaagttatctaaaaatctcttaaaatacatggtaaaggtctattaaaaataccgtttttcagttatacttatttagtttatgaacggctttaaagttcaaatatcactgttgatgtgtaatggaggttcaactatgagtcaagcgtggcataagatccgtcggggattaaatactcggtttggatttttcttgttcgccgttattctattttgtataaaatcctatatggcctaccaaatgaaattcagtttaggtgttcaagggcatatgcaagaactaattttggcgatttcgccaattgcgacggctttgtttctttttgggattggtttatattttcggggacgctgggcttattggtggatgattttaatggacgctatcttatccacgtggttgttcgcaaatattttgtattaccgagaattctcagactttattacgttcaatttaatcaagggatccggatcgacatctgataaccttggtaaaagtttaatgggcatcatgcgtggaaccgattttttggtttttgtggatgtgattttcctaattttgttattactcgtgcggtttatcaaaattgatacgacccggttcaaatttcgttatgccttggccaccaccgttttatcaattggtgtgtttggcgtaaatttgggcatggcctatagtaatcgttcagggttgttaaccagaacattcgataataactatattgtgaagtatctaggtttacagacatatacggcgtatgatgcgatcaaaacgtaccagaacagtgaacaaaagtcgaaggcctcagatgatcaactaaaaccgattgagaagttcttgaaaaaacatcatgtatcttcaaacatccagtacaagggtgtggcaaagggaaaaaatgtttttgtcatccatctagaaagtttgcaacaatttgttattgataagaaatgggatggccaagaaattacgcctaacttgaacaaactgtatcatgaaaaagatacgttgagttttgataacttctttaatcaggttggccaagggaaaacggccgatgctgaaatgatgcttgaaaactctttgtttgggttggcagagggtgccgccatggttatggatggaactagcaatacttttcaaagtatgccggctattttagatcaaaatggctattcgaccgcttcgttccatggggacgtgccgagtttctggaaccgagataatgcttataaatcatttggttatcaatatttctttagtaaagagtattacaagatcaaaccaggatatgtcagtggttacggtatgaaagataagattttcttgaaggatgccatgaagtacgtggaacaacttccgcaaccgttctatgcaaaattaattaccgtttcaaaccattatccatatttgatttctaaaaaagatgcatcaattaaagaatgggatactggggatccaacggtcgatccgtatgttcagactgcgcattatttggaccaatcaattggtgaattgatcagctatttgaagaagtctggtttaatgaagaacagtatgctggtcttgtatggtgatcattatggaatctcaaacaaccacaaagcagccattgctaaaattcttggtttaaaacaaatcgataactacaatttggccatgttccaaaaggtaccgttcatgattcatatgaccggactgaagggcggtattaaccatacttatgggggcgaaattgatgtgatgccaacgttaacaaatcttttgggaattaaagacccaggggccattcaatttgggcaagatttgttgtcgaaggatcgcaatcaaattgttgccttccgtgatggggactttgtttcaccgaagtatactaagtatggcaatgacttgtactttacaaagacgggacaacaaatcaccgataaaactgcaactgaaaagaaagaagttgccaagattcaaacttatgtcaataaagaattatccttatctgattcggttatcaatggtgatttactccgattctctaagcattcttggtttaagacggttgataaaactaagtataattacaagaaatcagctggtcttaaggaattgagtaaagcacaggaaaaagagccaacaagtttactgaagaaaaataaaggtaaatcaaccttagatctttataaaacagatgcaccagaactggagtctgaagattcaagtagcagtagctcttcatcttcatcttcatcttcatcagcatcatcctcttcttcatctaaataacgttatgtataagaaactcatggttaaacgattaatttcgttcaaccatgagtttttttgtaaattaagcttttttggtagatgcagccttggtgtcagccacattttcaacggttagttcaatgttgccatcagcaatcttagctacaagattttttgcatctggatggtccaaataataatcagcaattcgatcttcaatctgttcttgaattactcgacgaagtggacgagcacccatctttggattgtaacctaactcaactaatttctcttcaactggttctgtcacatgcacatgtaagccttgaacagctaacatctgattgacattgccaatcattaagtcaacaattttcattaagttttccttggtgagtgaattaaattcaacaatatcgtcaaaacgattcaagaattcaggtttgaagtaattacctaacttatccaaaactgagtgggttgtgccttttgctgcagcaccaaagccaacgtcagcttcaacgtcaccggttccggcgttagaggtcatgataataattgtatccttgaaactaacagtccggccttgagaatccgtcaaacgaccatcatctagaatttgaaggaacatatgcatgacatctggatgagccttttcaatttcatcaagcaagatcaaactatatgggtgacgacgaacttgctcagtcaactgaccggcttcttcataaccaacatagccaggaggcgaaccgatcaatttagaaattgaatgtggctccatgtattcactcatatcaaaacgaatcattgaatcctctgaaccaaatagttcgtttgctaattgcttagctaattcagttttaccaaccccagtggggccaacaaagaggaaggaaccaattggtcggccagtaccattcaaaccgattcggtttcgacgaatggcgcgagcaattttttcaacggcttcattttgaccaataaccttagcacgtaaatcttcaccaagattttgtagttgttcctgttcacgtttttgtaactcgccaaccggaatatccgttttttcttcgatgatctgttccatatctttatcagtcactgttggaatttcactctggttagttgcgccagacttagttttttctagtttattaacttggtcacgataataagcggccttttcataatcttcggcctttaaggcgtcttgtttgtatttttcagcattgtcaatcttttgctgaatggtagttggatctacggtattaatcgtgaggttctttttagatcccgcttcatcaagcaagtcgattgccttatctggtaggaagcgatcttgaatatagcgcttagaaagctttgctgcagccttgatcgcgtcatctgtgtaatgtacatggtggtaatcttcgtatttcttttgaattccctgtaagatacgaattgattcttccacactaggttcgtcaacctgaactggttgaaggcgacgtgctaaagcagcatctttttcaatatcccggtactcatttaaagtagtggcaccaacgagttgaaaatcacctcgtgccaatgctggcttcaaaacgttaccagcatccataccaccttcagcattcccagcaccaacaatttcgtgaatttcatcaataaagacgatcatgtctttattattttcaacttctttcataagttgttgcatgcgttgctcaaattgaccacgaattccagtaccttgtactaatgaaacgacatccaaacggacaatttgtttgttgattaatttttgagggacgtcaccagcgacaattcgttcagctaaaccttccacaacggctgttttaccaacgccggcttcaccaattaaaacgggattatttttagtacggcgatttaaaatttcaataacccttgaaatttctgaatcacgcccaatcacggggtcaatttttccctttttagccagctcagttaaattcagaccatattgatctaacaaaccacctttgccattacgttggttaccaccgttattaccggtaggaccgcttggttgagtggggggaacttgctggtttaatccttgtgggttttcaacatttccgttttgcattgcgcggaaaatgtcatctaaattcccaaatccaaatgggtcttgtgccatgtttgcggcacctccatttcctaagttatttccttcttgttgttttagaagttgatagcaattttgacaaagattaatctgcatccgttgtccattgacattggtatacaaatgaatcgttgcttcgttcttatgacaattttgacataacattttgctgactcctttcaaagaatcaaggtcaaaaatgtttgaccaactttgaccatgaccatattataacgcgccgaaaaaattgtgcaagcaatttgtatcgaaaaataactatcttcgaatctacttgtaaggcgtttttgtaggttcaaaaactagtttagcactttgacatatagagtgccaatgtttgaactttgtatcgttttcagctaaactgagtttactttataaaggcaggtgatcaaatggcacgagatttttcgaatttattggaacagctcagacaaggaacaattaaagaattaacggttgaaccagatgaattttcagaatttcaacctatctatatgaagtatgatcagcgaaaacgcgtaattggatcggctcaacgaaatgggaaagtagtttatcactttgaaactcatgaaaacggtgaacattaatttcacttttattcgtgaaagggcttgtaaaaatttcgagaaattgctatcatcaatgggaaaggctgattaattgttagtaagatgaatgctatgttcgttttataacttaaaaagaaagcccttactaaacttatatttttaaaggagatcgatttataatggaaacacgagactttcatattattgcagaaacaggtattcacgcacgtccagctactttattagtacaggcagcaagcaaatttaacgctgatgttaagttaacttacaaagacaaatcagttaacttgaagtctatcatgggtgttatgtcattaggtgttggtcaaaacgctgatgtgaccgtatctgctgatggcgatgacgaaaaagaagctattgaagctcttgcagatacaatgaaaaaggaaggactttctgactaatggcaaaacaattgaagggaattgctgccagtgatggcgttgcaattgcgaaagcatatatgcttgtcgaccctgatctgtcatttgataagaaaacaattgataatccagatgctgagattaaacgtcttcaagacgctttagacgcatctaaagcagaactagagttaattaagagtaaagctgctaaaagccttggtgaagaagaagccgaagtttttgaggcccacattacgattctctcagatccagaattgattggtaatattgaagacaagatcaagaatgacagcgttaatgctgaacaagcattaaaagatgtcactgatggttttattgaaacttttgaagcaatgactgataatcagtacatgcaagaacgtgccggagacattcgtgacgtgacaaagcgtgtcttgagtcatttattaggggttgaattacctaacccagctttgattgattcagaagttgtagtcgtcgctcatgatttaacaccaagtgatactgctcagttggatcgtaagtttgttaagggattcattacagatattggtggccgaacatcacattctgcaattatgtcccgtactttggaaattccagctattgttggaagtgaaaaagcaacaacagatattaaagctggcgataccgttgtgattgatgggatgcatggactggcactcgttaacccagatgctgatgaagttgcaaaatatcaaaaaatgcaaaaagactttttggctcaaaaagctgaatgggaaaaacttcgtgatgaaaagacatcgtcgaaggatggcgttcattttgatttagcagctaatattggtacccctgatgacatcaaaggtgttattgataatggtgctgaagctgttggcttgttccgttctgagtttttgtacatggattcaagcgaactaccaactgaagacgaccagtttgaagcttacaaacaagttgtttcaggaatgaacggcaaacaagttgttattcggaccatggatattggtggagacaagcaattgccatacttaccacttccggacgaaatgaacccattcttgggttatcgtgctatccgaattagcttggatcggacagatttgttccgaacacaattacgagctttgttgcgagcatctgcttacggtaaacttgcaatcatgttcccaatgattgcaactgttgctgaatttaagaaagctaaagccatttttgaagatgaaaagcaaaagatggttaaggctggaactaagatcggtgataacatccaagttggtatgatgatggaaatccctgctgccgctatgattgctgacaagttagctaaatatgttgacttcttcagtattggtacaaacgatttgattcaatactcatttgctgcagatcgtggtaatgaaaaagtttcatatttgtatcaaccatataatccatccctattgcgtcttattaaaaacacaattgatgcttctcacaaagagggcaagtggactggtatgtgtggtgaaatggccggcgaccaaactgctgttccaattttaatgggacttggtttggacgaattctcaatgagtgcaacttcagttttgaagactcgttcattgatgaaacgcttggacaccaaagaaatgaagaaattagccgataaggccgttactgaagcagaaactaacgacgatgtcatcaaactcgttaacgatgcaattaagtaacaaaatttagttttagataagtctctggggatctttaaatccttggagatttttttgttatactaaaaatgattaacaaaaatggagttgaaagtatgaagtttgaaacgagcgatctagtgacgttggattattcagatgagggaacagggcagcccgtagtttttttgacgggatttggtggctcaaaggaaatctggcatcaacaaaaaaagttgttattgcagcgtggtcttcgagttgtgaggctagattttcgaaatcaaggtttgtcgcagcatgttaattggggattacgtatttctagattagcagcagacgttcatgaattgtgtgtgttgttgaaattgaccgacttcatcttggttggaaattcaatgggtggggcaacgatttatgcttatctttctttgtttggtcctgtgaacgtgcacaaaattgtcatagttgatcagccgccgaaaatgattaatgaaagtgattggcagtttgggtttaaaaatttaacttggcaaaatttcaaagatcgtttgaagcaacctttaggtccgtcaactttcaaacatattgatgatgacacatttgcattagtcaagaaagtgacggagagttatccgtttgactcaaagcttgattatccgttgttactaaatcatgctgttcaggattggcgggatgtgattaaaagaatgtcaattccgatgcttttagttgttggacagcagagtccttactttgattatcattttagtgatgagattcaaaagatgaatggtacaatcaaaacggcaatggttgaaaaaagtggtcatattgtgatggctgagcaatcagaaaaatttaatcaactgttatggcaatttataggtaattaagagctacaagagagttgtttgcataacgcgtatgaaaccaatataattaaacttgattaagtttatagttttttggggaggatacttgtgaatataggaatttttacagatacatattacccacaggttagtggtgtcgcgacctcgattaagaccttgagggagcagctcgaaaaacaggggcatcaagtctatatttttacaacgacagatcctaaagtagacaaaaatgtgtacgaaagaaatatttttcgttttgcaagtattcctttcgtttcttttactgaccgaagaatagctgtaagtggtttgttcaaggcctatcaagttgcaaaagaattaaatttagatattgttcatacacagactgaattttcactaggctggattggtaagtttgtagctaaaaatttaaaaattccatgtgtgcatacgtatcacacaatgtatgaggactatttacactacgtggcgaatgggcatttgttacgcccttatcatgttaaacaaggtacgcgagctttttgttatcatttaacgggagttgtagcgccgagcgaacgagtgataaaaacgttaaacggttatggtgttaaagcacctattcgtgtgattccgacaggtgttaatgtgaatcattatgcccaacatgaagaaattgattggcgagagaaatatggttttcctaaaaaaaagaaaattttactttctttaagtcgattagcttatgaaaaaaatattcaagaagttattaaaaccttcccgcaaattttaaaagcagttccagatagtttgttagttatcgtgggtgacggcccagcacgagaaagcttggaactgcagactaagaatttggggattactgatcatgtgcggtttaccggcgaaattgataatgacattgtgtaccgttactatcaaatggcagacctgtttgtatccgcctcagattctgaatcgcagggtttaacctatattgaagcgttggcggctggactaaaggtggtcgtcaaatctagcccttatacggatcagttattggatgatccatcactgggagtgactttcgaaacggaaaaacaatttgtgcattttgcggagaattacttaaatcatccggttagttttgaagatcctgagcctcgggaacgcaaactttatgatatatcggcggatcattttggtaagcaaattgtagatttttataaagattcattagtgctgtatgcagatcgagaagagtcttcaagcttttctgactaagggggaaaagatttgcgaattaatatgttctcttcagcaacaaaagttaaaggacaaggtgtcggtagtgcttatgaggaattaatttcattactgaaaacacattttcccgacgagtttaaaattagtattaataaatatggacgttctgagattagtcattaccatacgattgatcctcaattttatttgtcgacgtttatgccaggcaggggtaggaaaataggttatgtccattttttgcccgaaacaatagaaggtagtttaaaaattcctcaaccatttcgagggattttttacaagtatataattgcattctataaacggatggatcatattgtggtggttaatccaacgtttattcccaaattaactgcatatggaattccagaagaaaaaataagctacattcccaattttgtgcacaaaagcgagttttatgagatgagttctgaaaaaagacaagcgttgcgaaggcaaatgcatatagaacaagataagtttgttattttgggaattggtcaagtccaggaacgtaaaggggttaaggattttattaagcttgcaaaaaataatccggatctccactttatatgggcaggggggttctctttcggcagaatgacagatggttatgcggatttgaaaaaagttgtggataatccaccggccaatttgaagtttacaggaattattgatcgttcagagttagtcaactattataacgtggccaatttgtttttgttgccatcgtataatgaactgtttccaatgtccgtactagaggcatttagttgtgggaccccagttttattacgggatttagatctttatcatgcaataattgaggggtactatgcgccggcaaaggatgttagtgaaatgcaagcacaaattagttatcttactaagaatactgatgcattaaagacattacacgagaaatctaatgaagcctcagcacaatattcagaggaacatttagccaatatttggcacggcttttatatgcgtcaggcaagagagggctagagtaatgtccaagagaaataaaattgtgttgatatttatgttaattctgggtattggtatatttggattttcattacggaatattaatctcaatcatttactacatgacattgttcacattcatgtgcaatggttattggtggcgataggttgcatgctgctttattttggaattgaagctgtcattacgcgaatgtttgtggttagtaacggggaccgtttttcttttcgagatgcaattcggattccactaattgaacagttgtttaacggcattacgcctttttcgtcaggaggccaaccggcacaacttgtggcattaatgcaaagtggggttgaggctggcagagcaagttctgtccttttgatgaaatttgtggtatttcaagctatgatagtgattaactttatgtttagtttactgattggctttgattatattgcggcaaagatgagttatctgtctttgtttgttgtgtttggtttcttgattcattttgcagtcatcatcggtttattgttagtcatgtactggcatggatttacaaaaaaactgattagttggattatgataccggttggatggtttgtaaaagaagatcggtatgctaagtggaaagtttctttggatgagaaggtagacactttttatttggaaagcgtccgtataaaatcgcagtggaaactgttgattaaaatttttataatgactttctttcaacttctcttttactacttagtgccgtattatattatgttgtctttgggatatacaggtataaatgtcattatggtcacatccttacatgttttgattgtcatggttatttctatttttcctattccaggtggttcaggtggggcggaatatagttttgatgttttgttctctggttttattcatagtaatagtaaattagttttagccatgttgatttggcgattattaacttattactttggcatgtttggtggtatgtttgctttagtgactaaaccagataaattaaatcgaacgattgtaaaaaaattatgaagtgaatttttaaccgtatttctaagtggaagtgcggtttttcttatgtttccaaaaaaagttttaattagttttgttcaggcttatcaagggatttgaacgctgatttataaaaaaatgggatttttgacttgaccaagtgatgaatagttgatatgatattcaaggtcgtttttgagaggcacagcttcttgtaatgacaatcaaatgttttttaaaagttgaaattggttgttgacttttagaaaaactgatgataaagttaaatagttgcgttgaggcgtttagcgcttccaactgcgacataaatattgtagagcctgcttttgatctaagtattgaattatccttcatcacaggatcgctgacgatttcataatcacctcaaaaaattggcaattatttagcctcatctgccagccaatcaaactccaaacccggatctgcatttaaagtggcatcaccacgaacaccatgccgatacagcatctcaccagcagcaccgatcatagcagcattatcgccacacaaagacagtggcactagttcaagtttggtatcggcaaacgtggcaacctctttggttaaccgctcccgaagaccttgattggcagcaaccccaccggcaagaattaattgtttgaccggaaattctttgagcgcgcgattggttttgtcagccaagacgtcaacaacggcttgctgaaaactagcggccaagtcttcacaactcaattcctcgttaatttgatcagcatggtgcaccgtattgataaaggcactcttcaacccactgaaactaaagtcaaaattatcgtcagcatccattgctcgtggaaaatgaaaagtatcctgacctttgtgagctaattcatcaactggcttgccagccggatagttaatccccaaaacccggccaattttatcataagcctcaccggctgcgtcatcacgagtttcaccgataatttgaaattggttttcctcaggcatgtaaaccaattctgtgtgcccaccagaaacaaccaaggccattgctggaaactcaatgggttcgaccagccgggcagcgtaaatgtgcccagctaaatgattcactggaacaagcggcaaattgtgcgcccaggcaaccgccttagcggccgtaacaccaattaaaagcgcaccgactaagccaggaccgtatgtaacagccactgaagtcagttcatcataagaaacgtccgcctcacgtaatgcatccccaatacagccggtaatctgctcgatatggtgtctgctggcaacttcaggaacaactccgccaaagcgttgatgactcttgatttgcgttgcaacaatatttgaaagtattcgattgccattctcaatcactgcgaccgacgtttcatcacagctggtttcaaaagcaagtactaaatctctagccacttaattcatcccatcccttttaaccgattttggtgatgtccaaaaccatatttaaagcgtcttcacgatcgttaaagtaataatcttttttaatcccgttatcaacaaatccaatatcccgatataatttttgtgcacgggtgttgctgacgcgcacttcaagcgtcaccttggcatattccaattgacgggcctttttgataattgttgtcaccaaaaaataccccaagccatgattctggaaatttggggcaaccgcaacgttggtaatatgacagtccttagtatgatcgtttagcgagcagccaataaacgctaccagccagtcgtttcgacgcaacactaaatataggcgatccgttttgcgcatcagttcggttcgaaaggcccgatcatcccaaggggtctggccaccgtaaaccgcccgctcaatccccagaatctcgggaatatccggaatcattgccttggccaaaaagtactcagttccattaatttctacatcgtggtttttgatgtcgagatatctctcgcgaagctgaacctctttgttataaaattgttggttaaaccactctttaaactttttcaacatagtcatgcgtatcctcattaggatgtaattttttccaatcagcctcagccttggttaaccgcaaatatcgtgggacaaccgcatcaacgactggtactggtgactgactcaatccatacaagcccagtaaggtcgcactgggaattcccaaataaggattggcaaccaccagacggttatgcagaacgtcgcgcatcgatctttcaaatggatcggtatcccctaaaatgataatccgttgatcgtaacggctaacggtttccaaccattttgttagattggtgtgctgatcctcgatcacggtttgaatccgacgacttcggtagcggtataatcccgtaaacatgttttgattccggccatcaaaaatcgggttgatcagcacatcttcttcttgaacattcaaggcaagatttaacaagctggaaactggtaccagctcgattcccaaggtgcttgcaatggttttcgctgccgtgacagccatccgaatgccggtgtatgatccagggccggcagcgacaaccacccgatccaaatcagttggcttcaaatcggccttttgcaccaagtcttcaataaccggcatcaagaattcggcatgtttgcgatgagtggtgatggttgtttgcgccaacagttggtcattatccaaaacagcaactgaaagtggttggtttgaggtgttaattgctaagattttcattattaatcgttaccctttgctttaatatccttccaaacaattgtggcacttgctgaaagaacatcatttgatttaatttcgtgaactgttttaattttagcattatctgaagaatcaacaagcactgagctggtgacccgattgccatacttaacctcgttctcaaagcggatatcaatgttcgcgggttcgtgttggttcaaaaagtccattggcaatgaatccaacatccactccggatacctggaattattgacgtggccgttaaaatcaatatcgctccaacgaacttggtattcctttgcgctaacatcatcagtcgcttcaattcgttcaggacgtgccaatctgggaacccgtttaaccttctccgactgatatggggcaataatcgtttcgtcaatcggcgtaattttgcgggtctgttcgttcattaacacccagatactctccaccttgaccagctcgttgccagcttgatcgtgcagccagaattcccgaaaggcaaaataacgattatatgacgtgcctcgggttgtcattttgacgactgaatctttgcgtggcaagtgagtgatatgaattgagtaagaagtaaccacccagccaactccataatgatcaattaaataagtttgatcaaggcctaaattttcgttctggtgttcggacgccaaaatcaaaatattgatcaacattggaattgaaatccggttgttgacgttacactcgtaaaacggaatcgtatgcaattcgctaaaactgtgagcaggcatggacattccttctttctatttgatgtcatggtactgattatagatgacctgtttttttaaatgatgatctttggcaacctttttgattgcttcattaacgctcaagccattttcgatgtaaaagtcaacttgttgatcaacgctcatcccggcaagcggatcatcaccctgcgtttgtggatgggcatttcctgacactataataacaaattctccgcgaatttcagttgaattggcccattcattgacctgatcaaggtttccgcgaatgaattcttcgtgctttttggtcaactcacggcagagagctgcctgacgatcccctccgagctgagtcgataaattcttcaaagtttttttcaatcggtgcggggcctcgtaaaaaatcattgtctcttctcggttacggagctcatcaatttctgctcgctgttccttcggctttcttgataagaagccatagaaataaaatggctgcggcaaaagcccggaagcaattaaagcagtgatcccggcgttggcgccaggcagcggcacaacgttaatctgctcacgaatacaggcaaccaccaattcatggcccgggtcgctaatcgacggcatcccggcatcgctcacctgggcaatcgtgattccctgcttgagtttgctaatcaactcgggaatccgctcggcagtattatgctcatgaaaactgatctgcttggtttgaacatcgaaatggttcaacagtttctgtgtgttgcgggtatcttcagccgcaatcaaatctgcagactggagaatcttaaccgcacgaaaagtcatatcatccagattgccaattggcgttggaaccaagtacagcgtgccatattcacttaatgtgtcaaaactcttttgtgtgtccactgtttacctcttaatcgcgtttgccatagataatgtccgtacagaaaatacaatcttcaccgttctcccgtcgcttaccgtaataagaactgcagacatgaaatccttcattgtacagtttttcgagattcttgcgagattttgacaaacgtggcgaattattgtccattttttcggttatttcgttaatccgatcgcgcaaatgctgattttcaatctccagctcagcgtttttttccatcaacccaataagtgattcatgcaggtgagaaaaattttcagcactcgcactgagctgtgtatccatttcttttaattcatcatataagttttgactgtccacgattttatcaccctttagtaaactatgattgcccaattgcgagtatctttagtgtcaaagcttcaattatattttgaaaattgacgttaactgccatccggctattcatatcaagcagctcgtcaagcatggttaacagttgatcgttattccactgattggccgccaatttggtctgtgcaagaatcgccggatacttcacccgatcatccgccaaagtcccgtatttcatttccaagacatcgtcaaacaaactcagcatcatggaaataacaatccgctgacggtccttgttggtaattagaggcatcaaagacatttggatgaaaggcattgccatgttgttttctttgaccaaataggtaaaccatttttccaaaagccgctgcatcgaggcaaaccaatcatctttggacagctctttaatctgatccaaactattggtaatggaaatcattaagttgacttcactcggcttgacaccactattctgtaattcttggaccatctgctttttacttaggctgggaaattccacaacctgagttctggaaataattgtcggcagaaccagattgcgattctgactgatcagaaagctaaccacgtttccggtaggctcttcgataaactttaagagactgttagctgccccagtggtcattttttcggcttctgaaataatgaaaacctttttggatccctccatggcacttttggtaaattcacttttaacgtggcgaatctggtcaaccttaatactttgaccatcaggttcggtgatgacaacatccggatgatcatgattcatgattcgcacacattcggcacattttccacagggcatgccattttgaacattcgtacaaaaaagccgcatggcaactcccattgcgactgaaaattggccggcaccatcttcgccggtaaacaagtatgcgtgtgacaattcattgtttttgattaaattcatgaattgggtaaagatggtcggctgtttagtttgagcaacgttaacaatatcgtgttccataacgttcccttctagaactgtttaaaatcttcgattggcaaaatcataaccgtagcgccaccaacttgaacttcaattggaaaggtatgttctgccgtatcaccgttcaagctgaccggcggtgtcataaattgttgtctagcggaacaggtttctttgattagtttcaaagttatatcaacttttgaatcatcaacggcgaccagataagtggtatttcctgctcgcagaaagctaccggtggtcgagaatcgggttgcgatgatatcgtgagcaacgaaaactgatcgcaacttgttggcatctttgtcttgaacgatcgcaatgactaatttcataatcaactctccttaaaatactcactggcaatttggtggataatcttaattgtatcattaacgacgcgattaatcggttgagttgcatcaatactgataaatcggtcggcattttcgtcacggaccttcatataaccctcatgaacccgtttatgaaattcattggtttcaacatccaaccggtcaattttactgcggtcgcggtgttcggcgatccgatccaggccaacgtcaaccgggatatcaaagtagatcgttttgaacggtaacaacttttccgttgcaaactcattcatcttggcaacttgtgccataccgatctgacggccggccccctgataagctactgaactgtcaacataacgatcacacagaaccaatttattctgtttgagtgcgggtaaaatggtttcaaccagatgctggcgacgagcagccgcataaagcaaggcttccgttcgataatccatctcagtattctcacggtcgagaatgactttgcggatttcttccgagattttattgccaccgggttctcgggtgaccaaaagttgatcgccgatttcctggttaaaaacttcaatcacgcgattcatcacggaagttttgcctgcgccgtccggcccttcaaaggttataaacttaccattcaaaacaatttcctcacttttaatttaaattaattgtacttgctgttcgtttgcctgtcgattcagccaacgcttatatggtccggattattcaaaattgtcatgatcataactgataaccgagggctgaatttggtaattcttaatttttcgaattcgtgcctctttatatatgaagaaatatttttgacgggccaacgcagtttcctgctccatctccatatcactgtcagcaaccgcttcttgggtttgagcagcatgatcccactcttctttcaaattgttgattaactccaacaagcgatcgtcgtattcacgtttaacattttgccgtcttaatcgattaaaaaacattcgaaaaatcccaccttgtcaaattaaatttcagtccgtccttggactgccttaaacaacgtgacttcatcagcatattcgatatctgatccaacggataatccgtgagccaaacgagtcactttgatcccagcgggtttaatcaacttgctcaagtacattgcagtggcttcgccttccggggtggcattggtggccacaatcacttctttaacggctttattttgctggagtcgtttgatcagtgaactaatattaaggtcttcaggtcctttgccttcaattggtgacagtaccccatgcaaaacatgataaaggccgtggtactcctggaccttttccattaccatcacgtctttgggttcttccaccactaggatggttgattgatcacgggttttatcacgacaaatttcacagggatcttcatcggttagattaccacaaatcgaacagtaatgaaggtcgttcttggtggcaaccagcgcctttgaaaacgctttgacatcatcttcattcatatcgacggtgtaaaaagcaagtctggtagctgtcttactcccgattcccggtaacttcatataactatcaattaactttgcaattgcttcaggatattgcatactttcccctttttttcgtgcggactacattcccggaatccctttggtgtatttacccatggtgctttcagtcgctttatcaacctttgaaagaccatcattaacagcagctaataccaaatcccccaacatttcggggtcatcgggatcaatggcttccggcttaatctggatatccttcatctttttgtcaccgccaaaggtcacttcaaccatgttatccggggcaacgcccttaaattcctgctgtttaagattctcctgttcttcacccagttgcttttgcatctttttcatttgcttcatcatcttgttcatgttcataccgttcatcattttcttttcctccaattaatcatctttgatatctaaaatgtcggtgccgaaaagttcggcagccttcttaacgactggttgactgtccggctcttcttttgtcggttccggatcgtcatcagccggttcagcttttgggtcgtttgcttctttggattgggagccagccttttttatcttgtctttgtgactggccaaatactcacggcgaatatcgggccactgattttccggaacaaacacaatttgaggggcttttcccacaatacgatccaaattgttttcaagagcatccttcaaatcagtgtcgccttgagccttctgatacaaaaatgggtattcgaaggcaacaattactccgccggcactggcagccaccggcgatgacacgtgcatgacagcccgttgggtcaccgacaaggcatccatcaagtccggccaaactgatttaaattgatttaattgtttccgggtggctttacccaaaattggatagattttagccagctcaatgtgattgtccattgagtgagcctcactgactttggcaggctccggcgtgctgactgttggtgactgaggtgtcgattcccgtttgagatcggcaacttccgccttgagttcggcaacttgctgcgtcaattgttgaatttccgcattaacttccggggccgcggccgttttagccgactgctgtgattgtggtgctgaaacggccttgggctgatttgtggcatccaaatgggtaattttgaccgtcaagacctccagataaacatctggatgagcggtaaaccgcaatgaattagaaatcgcattcaattcattaatcatctgataaatggcttgatcgctgatctggccacttaaggtcttgaactggtcatcaatgatccccagttccatttcttcaacgattccggggtcctgttgatacaacagaatatcctggcagtaactggtcaaatcttcaatgaaccggctggcgtctttaccctcatccaatattttttgaatggtgatcaacgcgctcttggtgtccttgttgaccacctgctgcatataggtggttaataattcattggtcacgctgccggtcacaagtaaggcgttctcataagtaattttattgtcaccataagacatcgcctgatcgaggatactcaaggcatcccgcatcccgccctcagcagctttggcaattaatttcaaggctttgtcgtcgtactcaacctttttttgatcaaggatatatttcattctttccaaaatatcctgaggtttaatccgcttaaagtcaaatttttgtgtcctggagatgatcgttgccggaatcttgtgcggttcagtggttgctaaaataaagattacgttagccggtggttcctccagcgtttttagcagagcattgaaagcccccgttgaaagcatatgaacttcatcgatgatgtagactttgtaatcagcctgagttggggcgtatttcgccttgtcccggatatcccggatttcttcaacaccgttgttggaagcggcatcaatctcaatgacatcatttaaactgccctcattaattgctttacaagtctcgcactggttgcagggctcaccatcttttaagtagtgacagttcactgccttggcaaaaattttggctgccgaagttttacctgttccccgaggaccggtaaacaaataggcatgactcgtttgtttagtaattagcgcattttttaatgttctggtgataatcgactggccgacgatctcatcaaatctttgtggtcgccaaacccgatataatgcttgatagctcattaccaaatcctccaaaatagaatgccaaattcttaaaatcgttcaatgaaacgtctaaataattatatgatgaatccaaccagagtgcaatcaacgaccgtctgactttcaagaaatttctccaaaaaaatgcccccagcaaagttgctgagagcaaaagttctatgtacaagaggcacaaggttgatgatacttagtgctgcttccttccggacctgacacagttcgtaacccgacccttgcctcagggccttgcggcaatatctatcataacttaaatgattcagaattgccagccttattctttcttttcttacgcgcagccttgaagaaatctttcatgatccgcgatgccgcatcggcataaagcccttcaacaacgttgacttgatgattcaatcgggaatcttccaacactgcatataaacttctggttgcgccggctttgggatcacgagagccaaaacaaacattttcaatccgcgaattaataatcgctccggcacacatcaagcacggttcaatcgtcacataaagatcgcaatcaatcagccgccaactccgcagtgttcgacaagcctcttggattgctaaaatttcagcatgggccgtaccgtcatttaaatgttctcttagattgtgaccacgcccgacaattgtcccgtcatggacgaccacggcgccaatcggcacttcaccgattagataggccttgtttgcttcgatcagtgcagctttcataaaacgactatcagcttgaaacatttcgaaccctcacgatttcttgatgctttgaagaatgtagtaacctttgtcccgttttaaaatctgacagtcaccaaataattcggtcatcaatttcttggcagatggtgcgccctgctttttttgaagaaccaccgtcaaggtgccgccatcaactaagtgatcgactgccccggagatcatggcatcgacaactttcttgccggctctcaccggtgggttggtcacgatggcagcatactgatcagtaatcgcttcatatatgttactttcaaaaatatgaacgttatcaacccgattagcgtcggcattctttttggcaagcgccaaggccacctcattgacgtcaatcatatcaatctgccgatccggaaatgctttggcaattgaaatgccaattggaccgtacccggttcccatatctaacagtttgccgtcaggaataaggtcataattaatatgattaaccagcacccggctgccgtagtcgaccgtatgtttagagaacacaccgttatctgaagtaaacactaagttgtttccaagcaacgcaaagttccatgtaatcggatcggattcaacgttgggattctttgaataataaaatgattgttctgacataaaattctcctaaaatgatcttttataatcgttatctatatttggtgcttacaattagttttgtcacaatatattgtgttttaatcgttgcatttcacactatttagtgtaaacttgaatcataaattaaattttaacgaaacaggggaagtgttaacaatggctaaaatcacactatattcaaagaacaactgtatgcaatgcaaaatgacaaaacgttacctttcagaacacaacgttcaatttgaggaacacaacatcaacgagcaaccacaatatattgattacctgaaacaacgagggttcatggctgtccccgttgtcgatgttgatggtaagcaagcattcagcggctttcgacctgatcagctccaatcgattgccggctaattgccttcatccattctaacatattgatttcagattagcgggcgaaaccacaaacggtctcgccccttttattcgcaattataagaaagcgtggtactaaatatgtcacttcacaaccttaaggatgttacctactttgatttgaacaacgaaattaacatccctgtcaacgggcagattccactgcaaaaagacaaggaagccctcgaggcctttttaaaagaaaacgttcagccaaacttaatgaagtttgacagtctcagcgatcggtttgattacctgatcaaaaacaactattacgaagccgattttattcataaatatcaactatcctttgtcgaaaaactgtaccagtacttaaacgatcaggatttccactttaaatcatttatggcagcctacaaattctacgcccaatatgctttgaaaaccaacgacaatgatttatatctggaaagcttcctggatcgggtcgccgctaacgccctcttcttcgctgacggtgacgagcagttggcaatggatttggccgacgaaattgtccaccagcgttaccaaccggccacaccaagcttcttgaacgccggccgggaaaatcgtggcgaatttgtatcttgttttctgattcaaaccaccgatgatatgaatacgattggccggacgattaattcggccctgcagctgtcaagaattggcggtggcgttggaattaacctttccaatcttcgtgaagccggtgccccaatcaaacatatcgaaggtgccgcttccggtgtggttccggtcatgaaattacttgaggacagcttttcatactccaaccagttgggtcagcgtcaaggtgccggagtcgtttacctctcagtctttcatccagacattatcgaatttttgggtgccaaaaaggaaaacgccgacgagaaaatccgcctgaagactttatcattgggagtgaccgttcccgataaattctaccaattgattaaagccgatgctgacatgtacttattcagcccctacgatgttgaacgtgaatacggcgtgccattctcttacgtcgacattaccaaggaatatgataatttggttgccaatgacaagatctccaaaaagaagatcaaggctcgtgatttggaaactgaaatcagtaagctgcaacaagaatcaggttacccatacatcattaatattgacactgccaaccgctccaatccgattgccggtcgaattgtgatgagtaacttatgttcagaaatcctccaggttcaaaccccatccactgttgataaccagcagcattacatcaaaatgggcaaggatatttcctgcaatctgggatcaaccaacattaataatatgatggctggcgatgactttggtcattcagttgaaagcatggtccgcgcattaacatttgtcaccgaccactccaacatcgacgtggttccttcaattcaaaaaggcaataaagaatcacattcaatcggccttggcggcatgggactacacagtttcttagccaagcaccatatgtactacggctcgcctgaatcgattgaatttaccagtgtctacttcatgctattaaactactggagcttagttgcatctaacaagatcgccaaggaacgcaaagaaactttcgtcaacttcgaaaacagcaagtacgctgacggcagctattttgacaaatatctggacggatcatttgcaccaaaatctgccgaagtaaaagctttgttcaaagacgattggattccaactaaggaagattgggaaaacctcaaggaatcagtcatgaaagacggcttataccaccaaaatcggttagcagttgcgccaaacggttctatttcttacattaacgatacgactgccagccttcacccgattatcaaccgaattgaagaacgtcaggaatccaagattggtaagatttattatccagccccatacctttcaaatgacacaatgccttactatacttcagcctatgacatggatatgcgtaaggtgattgacatctatgctgccgcacagcagcatattgaccagggaatggcattaaccctctttatgcgttcaaccatcccagaaggcctgtatgaatggaaaaacggccggacagacaagatgacgacccgggatctcaatatcttgagaaactacgcatacaaaaagggcgtcaaatcaatttactatattcgaactttcactgacgatcaacaagaagttggttccaacgaatgtgaaagctgcgttatttaaaggagaaattcatgactgagaattataaagcaattaattggaacgccatcgatgaccaaatcgacaaggccacttgggaaaaattaaccgagcaattctggctggatacccgaattcccctgtcaaacgacctatcggactggcggacgctggatcaagatcatcagtgggttgtcggtcacgtcttcgggggcttaactttactggatacgctgcagtcccaagaaggaatggcatcgttgcggaaagatgttcagactcaacacgaaaccgccgttttgaacaatattcaatttatggaatcggttcatgccaagagttattcctcgattttttcaaccctcaacacccctgatcaaattgatgagatttttgactggagtgacagtgaggaattcctacagaacaaagcactcaaaattcgcgacatttatgccaatgaaccagacccactcaagaaaaaggttgccagtgtcttcttagagactttcctgttctactctggcttctataccccactttggtaccttggtcacaacaagattccaaatgtggcggaaatcattaaattgattctccgtgacgaatcagtccacggcacctacattggatataaattccaaattggctacaatcaattgccaaaggaaaaacaagaagacatgaagaactggatctacgacttcctgtacaaactgtatggtaacgaagaaaagtacacccatattctgtacgatcaaaccggctggacagaagatgttctcaccttcattcgttacaatgccaataaagcgttgatgaatttgggtcaggatccgctcttcccagacacagcagaagatgttaatccagtggtcatgaacggaatctcaacatcgactgccaaccacgatttcttctcacaagttggtaatggctacctcttggggaacgtggagtcgatgaaagactcagattacgatatttaaataaatacctcacagtaactcaataaggctgatgcatccccgctgggatgcatcagccttatttttgtctaacaatcactaatctactaaatcctttggagtcttcccgttgaccatcgtctcaagattccccagtgagatatcaatcatatttttcacagcttcactggtatggaatgcggaatgtggcgtgaccaagacgtttggcatcaacgccatcttcaatacatccggatcattgacttttttggttgacctggagtcttggagatcagcagattcattttcaattgtatcgatcccggcaccagcgatttcaccgctctggagggcaaaaatcaaatcatcggtatcgacaattgagccgcgagcagtattgatgaggattgctgtatccttcatttgctcaaacacctcatggttaaattgatgataattatcatcagttgccggcatatgaattgagataatatcgctctcctgataaatttgttccaagcttttggcatatacaaacgagttgtcggtatttttcagcggatacttgtcataggcaattacctttgcccccaagcctttgaacagcttgatagctgcctggccaatccgtccggttccaatcaccccgacggtctgttcgctgatcagacggcccatgaagttgggcgaaaaatgaaattcatgcttttgatccaactgctgacgcatatagcccacttttctagagaggtacagtgacatcatcacagcaaattcagcaatactttctggactgtacgccggcacattggtaattttaacgccattggctttagcggctggtaaatcaatgttatcaaccccgacatttctgagcgataagtatttgattcctaagcgtttaaatgactcaaataattcagctgaatattgaatcgtttgaaggcaggaaataccgtcaaagccggctgcttcttcaaccgtctcctgattcaaagttgtggtggtgtatttcacttcaattccgtgatacttcccccacttctcaataaacggtatttcatcatctcggacattgtatacaataaatttcatagttgcctcctagtgatttcagcttaaatttggttccgcttccattttaccaaaaataattgttgaaacaaaatccaagtccacctgcagaggccaaagttgagtgaatccctgttgacaataaaaatagagctggaaatcaaggacacttatttccaaccctatttcaaattattttagttgatcaatgaaacgatcaaaggctgcttgacctttgtcgtcccatttgtaaacgccggcatcttccagaaccctgccaaagactttgccaacttcttcgtcgactacctcttcaacattgtccttggtaaaatggtcacgtttcatcaattcatctgcccaaggcttatgataatcagcaatttgattatcttcacccaagacatacttttcgacttctttcatttcggtcttcagacgagcaggcaaaattgcccggcccatgacttcaatcaagccaatattttccttcttgatgtgttgaacatcttgatgaggatggaaaataccatcaggatacttgtcagaagtttgattgtcccgcaagacaatatccatctcaaactggtcatcattcattcgggcaatcggggttaccgtatgatgtctggttccatccgtgtaggcccgaatatcaactgactcatctgagtagttcttccaagtttcggcaatccgattggcagcattcacaactttattggcatctttgctgaccaggcgaatggttgccattggccatttgacaattcctgccgacaagccatcaatccccaaatcaaccggtcgatcaatcttggctttcatcatcgggaacgtgtggcgaccaccttgatagtgatcttgagccaataaggaaccaccaacgattggtaaatcggcgttgctgccgacaaagtaatgtgggaactgcttgatgatgtcaaccaaattgacaaacgtccgttgatcgattgacattggcacgtgcttttggttaaggaaaatcgcatgctcaccaaagtatgcataaggtgagtattggaatccccacggttcgccgttgatcatcatccgaataacccggtgattgcttcgggctggatagcctaggcggccgagatagccttcattttcaatggctaacgggccaaccggataactggttgactttgcccggccagcggcagcaatcgccttaggatccttctcaggctttgacaggttaatggtaatttccagattgccataatcggttttggtttcatatgaaatatttttggcaatcgcccgagtcttaatataatcattgtcttggctcatatgatagaagtagtcggtggcggcatcaggagattgttgatacttgttccaaaagatctgattcaaagttgatggaattggtgttaacaggtccatcagttgatcttcaagaatctccctgttggtaatcgaatcttcgaccttaccatgttcaatggcgagatccaccagatcgttggctaagtcgacagccgacgaatcctcggtcgactctccaaaaccatcgccgatcagtctaaaaatcaggttggtgacataaatccggtcaacatctgaatatggtgaatcagatttgataattaaatcgacgaacttttcaactgctgattggctcatgattactgatttcctttccgatcgtcataaccctttgggtgggtttctttccaattccaggcggtctttataatttcgtgaacgtcatcaaattgaggcttccagccaagaatcttgcgggctttgtcactcgctgcgatcagcgtgcttggatcacctgcacgacgggggcccattttggcaggaatcggcttgccagtcacatcacgggcagcatccaacatttgtttgttggaaaagccggttgatgagcccaagttaaaggcatcactatcatgaccagcttggagatacttcagtgccaagatatgcgcgtcggccaaatcaagcacgtggacgtagtctctgacgttcgtgccatcaggcgtatcataatcgtcaccaaaaatcgtcaactcatcacgttcgccggcagcaacttgtaaaatgatggggaccaaatgggtttcagggtggtggtcttcaccaattgagccatcaggcttggcacctgcaacgttaaagtagcgaagggcgacaaacttaatgccgtaagccacatcactccagtgcatgatcttttccattgccaacttgctttcaccgtatgggttggttgggacctgcggatcagtttctttaattggaatctgcttgggttccccataggtagcggccgttgacgagaagacaatcttcttaacgttatgggcgttcatcacttcaagtaaactaatcatgccaccagtattattgtcaaagtacttcaatggcttttccatggattcaggaacaactgagaatgctgcgaagtgaatgaccccttcaatctcttctttatcaaagacttgattcataaagtctttgtcacggacatcaccttcatagaaacgggccttgggattgatggctgctttatggccggtaaccaaattatcaaccaccgcaacgtcatagccattttcaattaatcgatcaaccgtgtgcgaaccgatatatcctgctccacctagtactaaaattgccatttaaatatcctccttctaatcaattcgttacttaatctctttaggaccatctgaaatttctgcaatgtagaattctgccggatggccaatctctttctcatagacttcgccaacatttttggtaaaggcatcgacttgatcacggtcaacaatcgcaattgcacaaccaccaaatccggcaccggtcattcgcgcaccgacaacgcctggttgtttccaagcagtttcagctaatgtatccagttccttaccggttacttcgtaatcataatgcagtgaaacgtgagatgcattgactaatttaccaaaggtttccaagtcattattgaccagcgcatcctttgcctgaagggttcgttgattttcgaataccgcgtgacgggcacgacgaatcaaaacatcatcattgatcaggtaactattttcatcgaattcactttcactcaaatcaccaagagatttaattggcaatcccacttggagacgcttcaaagcctcttcacattcagcacggcgttcgttatatttagaatcttgaagctcacgatgtttcttggtattcataatcacaataacccgatctcccaatttggcgggaacgtaatcatatttgagggtattcgtgtccagaagaattgcttgatccttcttccccatcccaatggcaaattggtccatgataccggaattaacaccgatatatttattttcaaccagttgaccatatttaaccaggtcaagttcgtcgatccccagtgaaaagacatcattaacaatctctgcagtcaacagctcaatagatgctgatgaggatagtccggcaccatctggaaggttaccataaacagcgagatcaaagccatggccaatcttatagccgtgttcgagaatctgaacgagcatgccttttggatagtttgtccagccatcttctttgttatatgccaaattgtccaacgatacttcaacaattccagcatcggaaacgttgccggagaacatgcggatcttgttgtcttggcgttctccataagctgcgtagatgcccatgctgattgcacaaggaaatacgtggcccccgttataatcagtgtgttcaccgatgaggttaattcgacctggtgagaaaaatactttgcttgagtcataaccgaacttgtcattaaatagcttttgtacgtcatcagaaatcataaatttcatccctctacatatattttagtaaactttactaaccaaaatttaactcattttggcagcgttgtcaaccttaacttcacaattccctcacttgtaaaatacaattgagaatccttgatatgattgaaccacttggatgttggtgaagacttcgtgaatgtggataaattttatgaaaacgcttcatcagtttccaaacaaagccttttatatcaaggtaaatttcagtaaacattattttgatgaaaaattgttggtatttttacatttaaccgcacaaaaaagccagcagatatctgttaaataccttccggctgctgtttaattgattgtctgccaggttacttaaccgacaatcaattaattttcgactcagtccgccttatttgggctgattggcgtccataatgtaccagagtgccttggagaggcctgccggctttttattgcgcggttgattaacaaccaggataatctgcagaaccgcgtaaaccagcccgcttcgacgataatacgcaatatattttgactcccacttatcaacgtacttgtccttataagaccggagtccctcaaaactataaagcttataaccgtattgatagatgagatgaacaatccgctcctgagtgaaactgaagcgggaagttcccacatttgagaacggtgacatccccaagtcaaagtacttgtatcctttatcgtgggatatttcataaagattaatcaaaatgccatccatgatgcctgatggggcatcggcggaggaacgcatgagatcaatcgaggtgaccactttattaccatccggcatcagattggcaaacgcaacaattttgccggcatggtctttcatcacagcaatcggtgcctgctgaaggtagtattcgtcaaaaaagccgagtgagaaacccttttctgctttattatccaaccactcgtcagaaatcttccgcagagtggccagcaactcatctgaaaacggtggctgtagaatttcaaactggtagccttcgcgatcgaatttgtgcattaatgcccgttcgccgcgatgtcgtttaccactaagagtgaactgatccaagtcaactaatccatcctcaccggtcttgataaagtcaaacccggtttcgtgaaggctcatggttaattcttcatcaatttcgtagaataccagtttcagatctgatttatcagcttccttgacaaaatcatcaatcgcgtcggcaaattgggcacgattgccgaccggctcgcccataattaacagtttgtcagcaattttcttgaacatgaagaaaacctgatcttcgccgtctttgctgtaaaagtaaatctgcttatcgcgcaagaatgccagatgactatcctcattgccaccgaatttatcaatcacagccttcacccgatcggcatcaaatcgctgtgtcagccattctggatggccggcggtcaagtaggcattcatcccaaccagaaccgccagggcgatcaataagccaacaaaaccgaccagccaggcacccgcagatggaaaaagataagctttatcaaaatggagatgaagatttcgattggcagcaatcccgatgagggtataaattgcaaatgtgatgataaaaattgacccattaaacaggaacacaccccaggaattagccatccggtcccggtataacaccgccttggagagccgcagagtgattaggatgatcacgaacagcaagaccatccgccaggtaaacgcctcgttaaaccatgtgttaaatatcgaaatgatcagcacaaataccgtaggggcatacgctttcttagttcgagtccagataccactcgccaaaccgattaagaggaatgcaacaataatattcatcatatgactgacgaaaaaaatcgaatatggcaatagtttgacatacagtttattaacaaccactacattgggaaccgtggcaaacaacaacatcataattccggaaaaatacataaagccagttaagaagacttgggcaatccgttgaaacagaagtcgtggtaggtcatcgagaaaggtgttgagtttggacccggtatcgtgaatgaacagaccagtgcccacaatgaatggtaacaagtaataaaacagacggtaaagcagaatccagaccagtgcatcacttcgggcaacgccaatgaatcccagtccaatgatgacaaagatatcaaaggaccctaatccacctgggatcatcgagacgaccccggcaacgttggcaaccacaaaaatgggcacaaccaatcggaggtcaacgggtagattcatgagataaccaatcaaaataaagaaccccagggcactcccccattcaaggaacgagccggcggtcatgaccagttcctgtttggttgacaggtcactgaaaaactgtgaattagtcacttgggtaaaaatcatcaccccgggaaaatatacggcaccgcccaatagccaaatccaatagtgggcaaattctgtcccgatcccaaagccaaagatcatgatcagtgaaaccaagcaaagtaaagaaagccctgatatcagaaacaaagcaactttagaaattgcatagaggatctgtttgcgggtggcccctttgccatagaaatgcgcgcgtaaactgccgcccaacaatccgccaaaccccagtaaattcgtaaaggtattcaccacccagccacttttaacgatgtagccgggtgaaaatttagttggtaaaaactgaacaattgaatagtcgtacaccagcatcggcagaattgaaataaagcctgccaccagcattatcaaaagagcgccgcgactttgactggccagaacggttttgaactgttcaccgttgacttcacggataatcttagccaactgtcgaataacaaaaatcaaaacggagaagacaaaaatcagcttgatcatggtcatccgtttgtcgatgaattctttgacacgtgtcattattgttccaccatcatttcattttgaatatgtactcttcgtctattatgccaattaattgaatttcacacaacaaaggtgcacaaaaaaactgtgcatcgacaatgtcgatacacagttctgagaacaattatgattaagcaatgaattacttaagggtaacagttccaccaacggcttcaagttgttccttgatcttgttggcttcgtcttctgaagcgccttccttgatgattgatggaaccttatcaacaagtcctttagcgtctttcaaaccaagaccggtgatgtcacggatagccttgatggctttaaccttttggtcacctgattcagttaattcaacatcgtatgaatctttggtagcactgtcgccaccagcagcacctgcagcagcaactggtgcagcagcagaaacgccgaattcgtcttcaattgacttaaccaagtcgttaaggtcagagattgaagcatcttttaattggtcaataatattatctttatcaaaagccattttattttcctccattaattggaatttatttagttctgattaggcagcgtcgccatcgtcagattgtttcttatcagcaattgctttaaccccatatgcaaagttacgtacaggtgcttgaagaatgttagcaagagtagataacaattcttcacggctaggcaatgcagcataagcagtaatttcttcaagactggcaacttcaccatcgataacgccacccttaagcttaagtttgtcgttagtctttgcaaagttgtggacaatcttaggtccggcaacaggatcttctgacgagaagacaacagcagttgggccgttgaaagttggtttcaaatcatcaaaaccggcttcagcagcagcacggtccattaccttgttcttgataacttccatcttaacgccttcatcacgtaattgctgacgtaaatcagttacctcggcaacagttaaaccacggtagttaatgataacgacagatgaagcattcttcaattcttcagtaacagatgcaaccttttttgctttaatcgcaacagtttgttcactcacgaatttcacctcccaaaaatttgttgggacttaataaaaaatccctatgcccacccagacataggaaaaaagtaaacttactttcctcggcaggatattaaggcatagaagccacctgagtcttaggcgaatatatcagcaactaacagtctatcacacaaagtaataacccgtcaattagggattttttatttaaatcgaaactaattaagcttcaacgcttgagaatgagtcaaggtcaactttgacgccagggccaaatgtagttgagattgaaacgttgttaacgtaaacaccacgtacagaagctggacgtgccttcacaataacatcctcaattgtcttcaggttaccaacaagcttgtcggtatcaaatgaagctttaccaactggaacggcaacgttaccgtcacggtcagtccggtaagtaaccttaccagcttttgattctttaaccgctttggcaacatccatggtaacagttccagtcttagggtttggcatcaaacctttaggtccaagaactcgacctaaacgaccaacttgagccatcatatcaggtgttgcaatggcaacatcgaagtcaagccaaccatcttggatcttttgaactaagtcagcgtcaccgacaaaatctgcaccggcatcttgagctgccttagcgttgtcacccttggcgaatacaacaacggtctgttccttaccagttccattaggtaagacaacggcaccacgtaattgttgatcggcctgcttagtatcaacgtttaatttgaacacaatttcgacagttgagtcgaatttagcaaaatcaatatctttaatcaattcaacagcatctttgattgggtatgctttttcagcatcaaccttttcaagggctgccttgtagtttttacctcttttacgagccatgtgtgttttcctccttgcttgtggttataacggattaacctcccacgcgatgtgaaacagtgtgtcatcgttaaagtaacgacgtaaccgggttgactatccttcgacagtaaagcccatgctgcgtgcagtaccttcaaccatgcgcattgctgcttcaacatcagctgcgtttaggtctttcatcttagtttcggcaatttctttaacttggtctttggtaacagttgcaaccttgttagtatttggttcgccggaacccttttgaacaccagcagctttcttgagtaacacagcagcaggtggagtcttggtgatgaagtcgaatgaacgatcttcatacacagtgataactacaggaataatcatccctgcctgatcggcagtacgtgcgttaaattccttagtgaatcccatgatgttgatacctgcttgacctaatgcaggaccaactggaggggcaggtgttgctttgcccgctggaatttgcaacttaacaatattcgctacttttttagccacgagacataacctccttaagtccgtgtgtggtaaatggagatcaaaatttctcctcccacgttggtatgcttaaacataccatactaatataacataaacattttcattcaacaacctaaattattggttccaaagaaacttggcaatttcttggtcgacaatgacattttcatgaagcagccgatgggttgcccgtttgcctcgaatcaccaattcatggtattgcgcggccggatcctgcagtaaatagcgcaatgaaaaagcactgttcaccgagacttctccgtcattttgctgggtgttgctgatccggccggcaatattgagaaccttaatgtcccttggaattgcaaaaacgcgttgtgacagcgcccgataaatcggcattcgtttggttggccccttggcgttcaacggataagcgtcaactttatcggtacttctggcaatctctgaatcattgaatggtccggcgatcgccacaacatgcttcacgctgacaggcgtcattttgctctggtgggtcagaaaccaaaaaatggtaatacagcccatggaatggccaaccagattgatctcttcaacaccatagcgggtattgagcacctccaaaacttcagagagccacactgcctgctgccttgggcgggaagacttgtcggcaaaaagaacttggatcaggacctttgacttcgccagatggcctgaaacatggattttaccgtggcggtcgactttgatgaccatcgatttgttagcaccgtactgtcgagttaatcgattgatgagtctgccaaatgacaatcgattaccaaagtagcccggaataaaaagtgtgggaatggcctcaatcccatttgccggatcggagtcaataccaacctggttgggcgttccaagccgaatcagccggccgacaaccaccatcgcaatcagcaaaacaattatcaaaccagccatccataccatcgtgaccacctacttttggttaaagggttgtatcaatttgattgaagtcaagatctgtactggtctcacggccaaacatttcgatattaaccttaagccgttgcttttcgttatcaacttcggttaccttgccatcaaggccggtgaaggcaccatcaacaattttaaccgtatcgccaatgttgacatccaaatcttcatggcgagaactcatgccaatccgtttgagtaccaaatcaacctcatccggcagcaatggcgttggcttacttccctgtccatgagagccgacgaatccggtcactccgggagtgtttctgacaatgtaccaagcttggtcggtcatgatcatttccaccagcacgtagccggggaaagtcttgtccatcttaactttgtccttaccgttctttacttcatgttcttcttgttcagggacaaccgttctgaagatgtaatcctgcatccccatagattcttttcgactgtccaaattcatcttaactttgttttcgtatccagaataagtatgcaaaacataccattgcttttctgctgactcgaccatgtttttctgctccttcgtaattccagtaaatgagttcaaataaaaaaacctgacacttttcgcaggtttcaacaacttaactatatcaaacattgactcaaaaggctatgccagaaattggagtgcccattgaacgatccagtcaaccaagcctaaaaagatggccatgatgattgaagtcccgataacggtactggtatcagtccgcgtctgagatgcgttgggccaagtgaccactttcatttcctgagcaacttttttgaaaaaattaattaatcgcaaaattttatccccttatatcatgattaacgagtttctttatgcaaagtatacttaccgcaatacttgcaaaacttattgagctccaagcgtttggttcgattggggttggcgggaatcgtataattccgtgaaccgcaaactgaacaagccagagcaacttttctttgtgccatagcggcacctccttacaagcatagtaataatagcattcaaaaacaattccgtcaatttatctcaccgtcaaatttgcgccgacagcgttcaaaagcgttgataattcctctttgcgctttgggatccaaatccgcataaccattttcactgagcatcaggttaaacgcccgcttttccaatggtgaacagctgctgtatagtttgcggagtgcatcatcgacgatcaccgcatcaattggactactagctgagttatcggcgattttggcggcgtaaaaatactcgttggcttcaaatgatgtcaatggttctaccggcacccgtttttgggcattgttggtgcgaatcaggtcaaacaagcgatttcgcagattatgactgaaaaaggttccaaaactgacttttcttgcagcttcaaaccggcacgccgagcgaaacagaaccattcgggcttcctggtccaggtcgtctttatcgtagccgttgatataatactggcgtttgtacttgcggacgattggataatattggtgaaataactgcgcaaaggcctcttcatttcgtttagctgtttgacgaatcagttcaagtcgattgttaggtaacatattgttatccccctcaaatgtttttattaatcagattcgattacgaaaaacattaacggaggattcaacttccggcaagacgaaccagcgttcattcagtgaatatcccacctataccaattttaaaatatcagcatactaatatttttattgaccatcatgcatcattttgtcccgcagcttctctaattcaaggagctgtttggcgtcaaatggcgtgtggcgaaacacttggccttgatcagtcatcttgcgcgcttcagtatcaacttcctgtttggcacgctgaacatctctgagcaattctctggctgggatccgcaatgcgccggcagcaaaaatcgtccattgctcggcttgatcgctggtagcaacgatcacctgggtaaatcgattttgcttgcgatgggccaaggcctcaatgtaactatcggcagtctgatccttactggtccagacaatctccatatcaaacttacggaagctttttgaattaccgggaacgtacatcgcgtcaaaaacgacgatcatattgatgtcccggtactttttatattccgacaattcagccagcagttgatcgcgggcatcttctaaacggttggcctgcttgagcttgttgaggtgcggccaattgccgatcatattataggcatcaacaattaacaggtcttctttcattatttctcaccgactttattttgataatgggtggcgggaattaaagccctgataaatcaaaatgctagctgcaacgctggcattcaggctttgaatatctcccaccattggaatggtcaacatttcgtcgacttgtttcttcaacagcggcgaaattcccttaccctcgttgccgataataacggcgattgagcctttggcatcccaacgacggtaatcagttccggaaacatcagtcccaaagacccacattccgcgttgctttaattctttgatggttgccgacaaattggtcacgcgggcaactggaacccgttcaatggctccggctgaagttttggaaaccgtggccgttaatccgactgctcggtgcttaggaatgataatgccagacaccccggcagcatcggcagtccgaataatcgagcctaaattatggggatcttcgatattgtccagaatcacaaagaacggttcaaccgcttgcttcttggcattggtaaatagatcgtcaatcgttgcatacttaaaggctgcaattgataataccaccccttgatgattttggttattggaaagcttgtccagcttttgctttggaacctttgaaatcaccagccgctttttatgcgccaatttcatgatttcagagataatattgtcgtcatctttgattcctgactggataaacagtttgttaaccggattttcactctttaacgccgcaaccacggggtgtctgccaatcacaaactcttcaggctgatcctgactgtcatcgctgcgatgatcttgacttcgattatcattcttcatgtttgaggttcccactttctacttgttcaatacaccaatttgcgatttctttcattcgatccgtctggtcactcagtgataggtagccaaagactgcttcaaacccggttgaaatgcggtaggtaatcacgtcggtattcttggcgtgcgtgtgactgttggcatttcggccgcgtttgaagtagtcccactcagtttcattaagcagaccatctgttttcattaaatcaattaaagctgcctgcgcctttgcggatacatagttggtagcaacatgctgcaggcgcttaggcttggtcaacccctgggcaatcaaatgccgacgaatgaaaacttcatacgcggcatcccccatgtacgccaaggcaatcccgtttaactgggaaaaattatcaatcattaaagttgttattcctttctaaaccgggtcccctgtggggtatcttccagcacaattccccgggctttaagttcttctctgatttcatcactgcgaataaagtctttgtcatggcgagcctgttcccgttcgtggatcagtgaccaaatctcatcatcctttagttcactttgctcaagcttaatgccaaagacaccagataattgacgcagggtgttgataatgaactgcaagctcaatttgaagacagtctcgcgttcactataggtgttggcaaattttgcgagttcataaacggcggcaatcccgttttggacgttaaaatcatcgtccatcgcgtcagtaaagtcagcgacaatctggcggacttcctggtcggttttgggatcatcaccctcgtcagcattatgaagccgatattcgaggttgttgaaggccgtctgcagctttttcaagttgctgctggcttctttgacactggcatcactgtactggattggacggcgataatgggtggtcgacatcaatagccgaatcacttggccatccaaattcttaagcagatcatgaaccgtgatgaagtttcccagtgacttactcattttctcgttatcgtcaccaattgtcacgaaaccgttgtgcatccagtatttaacaaacgtctggcctgtgttggcttcgctttgagcacgttcattctcgtgatgcgggaaaattaaatcttctccgccaccgtgaatatcaatcgtttttcccaagtacttggtggacatgaccgagcattcaatatgccatcccggccttccctttccccaaggagaatcccacgaaatctcatcgcctttggactttttccacaaggcaaaatcaattgggtcttcctttttagccatttcttcaggattaacatgctggctggcaccgatttccaattgatcaacgttgatgtgtggcaaggcaccataacttttgaattttcgagcccggaaataaacgtcaccgtcaacatcgtaggcatagcctttatcgaccaaggttttaacgaagtcgataatttcaggaatgttctcagtggcccgggggtgaatcacgttgcttgaaatgttcagcgcagccgtgtcctgcataaatgcgttgatatacttgtcggcaatggcgccaactgtcgtatggttctgtcgagcagcattaatcatcttgtcgtcgacatcagtaaaattcgaaacgtacttgacttgatacccccgatactccaagtatctgcgaacagtatcaaaggcaatcgcgcttctggcatttccaatatgaatgtagttgtacacggttgggccacagacatacattttaacaacacctggggtgatgggttcaaatttttctttttttcgcgtgagggtattaaatatctgcaacatttcgaattcctctctttatcttttatattcaaataatatcataattcacattgttttattactttaactataacccataataaaaggtctcgctgtaaatgcaacgagaccaatcgaatcaataatattttttataaattacgctttatcgatttgagccagtgtttctttgatatgcgcgatggctttttgctttccgaccagttcaacggactctggtagttccggaccgtgcatttcgtgggtcacggcaattcggattggcatccataattgacgtcccttgatcttagtgtccttctggatggctttgatgactttaaagatttcaacggagtcaaaaatgtcgagtttttgaattcgctcaagaaattcttttaagaccaccggagccgtttcattggaaatctctgccaatgcatcaccgtcaatttgttccggctcttgaaagaagaccgaggccatgtcgttaatctgagccatataactcatttcacgcttatagagcataatcaactgacgagcccactcgattgttttgttgtcgggattttcaggaatattcccaccggcaatcaactggcgcagcgccaaatccatgatcgtactgttatcggcttccttaacgtactggttgttaatccattccaacttcttggaatcaaatttggcaggtgacttactcaaacgagtctcgtcatacatcttgatgaattctttcttggtaaagatttcatcttcacctaccggcgaccagcccaagagcagaatgaagttaaacattgcatcaggcagataacccaatttgcgatactgttcaataaactggaggactgattcgtcacgcttacttaactttttaccggtatcagcactgatgatcaaactcatatgcccaaatcttggtgcctgccagccaaaagcttcgtaaatcatcaattgctttggcgtattggcaacatgatcatctccacgaaaaacgtggctaatcttcattaaatgatcatcgcagacaacggcaaagttgtatgttggcatgccatcacgtttccggatgacaaaatcgccaccaatggtatctgaattaaaggaaactttaccttttacgatatcatcccaagcatattcatggttcttgggaactcggaatcgaataaccggttttaaaccttttgccttggcgtcagcaatcgcttgggccttctggtcttcggtcattccttcatattcatattcataatgaggcatttcgccgcgtgctttttgggcatcacggtcggcagtaagctgctcctcagtccggtatgattcataagctttaccctcatcgatcaactgttggatcaatggtgtgtaaatatcttttcgttctgattgacgataaggaccataatcgccaccaacatcgggaccttcatcccagtcaagaccgagccactttagattatccagttgactcttctcgccgtcggcaacatttcgtttggtatcagtatcctcgatccgaatgatgaatttacccttgttatgacgggcaaataaatagttaaaaatggctgtacgtgcattgccgatatgcaagtggccggttggacttggagcataacgaactcgaattgcattgtttgccaatgtataacgcctctttcttaaaaataatcaaaattttgtcagtgtttaaagtgtacaatgaacttcgccaaaaataaagggaaggcggctacttcttgttatttgacccattcttgccattccctttattctgatcaggcttatcggtaatgttcttggtcgaatgttccggacgggcgaagaccattttacctgcatctgtttgaatagcactggttacgacaacatcaatgtgatcattcaagaagtatcgaccgtcttcgacaacgaccatcgtcccgtcatccaaataagcgaccccctgttggcgttcggttccgtttttaacaaccatcacgttcaacttctggccgggcagaatcttctgccgcagcgagttggcaagcgcattaatgttaaatacctggacgttttggaattgaatcactttgttcaagttgaaatcattggtgataattacaccatcaacgtctttagcaagctggatcaacttactgtcaacttctggaatgtcctcgtaatccttctcgtaaatttcgatcggaatcagatcttcgttctgcagcttgtttaaaatatccaggccgcggcgaccacgaacgcgtttgacgctgtcactggagtcggcaatgtactgcaattcatacaacacaaacttgggaactaacaaggtgccttcaataaacccggttttgacaacgtcataaattcggccatcaatcaaaatgttggtatccagaattttgtagtgatgatagttcttatcgactggtttatcgataatcttttcgtcgccggccttggcagtttctgacttccgccgggattgaaacatttttcgccagcgatcactctgcgtattgccaattcggaagccaaaatagcccagtaccaacattaagatcgttggaatcatggtattcaagaagaacgtgcgggttctgaagaatacaatcgaaatcaggatggcaaccaccagcccgataatcaggcccaaggtcccaaaaaataacgacaacggactttgctttgtcaatctgacttccacccgatcgaccgctttgagaatataattgccggttaacaacgaaataaaataaaaaataattgcacccacaactgcgtttgtcgcagtgttgttaaacagcgtcccatagcggacttggaatatcagccagatcatcggaaaataactggctccaattgcggcgccggctaatgtaaatacaattctaacaattctctttcttttcaaaaatatcgccttctctcaattttcctttaaccaagtgcaagctttaaagcttgagcaagggttgaaaccccaactaccgaaatgccagtcggtggattccagccctgaagattgttggctggaaccaagacccgtttgaaaccgagtttttgggcctcagcaacccgctgctcaattcgggtaacgcggcgaacttcaccggttagcccaagttcgccgacataacactccgtcgggctggtgccgcggtttttgtaagatgaagcgatgctgaccgcaattgccaaatcaatggccggctcatccagtttaacgcccccggcagcctttaagtaggcatcctgattctgcagcatcaatcccgcccgcttttccaaaacggccataatcaacgacacccgattgcggtccagcccagtggcagttcgttgcgcattaccgaaaaccgaggccgttaccagagcctgaatttcaaccaggattggtctggttccctccatggaaacaacaatggccgatccggtagcgtctttcagccgttcttccaagaagatttctgaaggattcttaacctccctcagaccgtcagtccgcatttcaaaaacgcccagttcattcgtcgagccaaaacggtttttgacagtccgcaaaatccggtaagaatggtgcaggtcaccttcgaaatacaacacggtgtcgaccatgtgctccaaaatcttcggcccggcaatcgcaccgccttttgtcacgtggccaacaacgaatacagtgattccctgacctttggcaatgttcattaaatcagcggtcacttctcgaatctgtgccaccgatccagttgctgactgcagctctggaatctgcatggtttgaacggagtcgatgaccactgcatctggcttcatctcgttaatggtatctttgatgacatccatatcggtttcggggtagacataaagattttccccattgacaccaagccgatcagcccgcattttgatttgggaggcactctcttcacctgaaacgtacaaaatcttaccggatttactgagctgaccggaaacttgcagcatcaaagttgatttaccaatgccggggtctccgccaattaagatcagcgatcctggaaccacgcccccgccgaggacccggttaagttcttccatgtcggttttaaagcggatatccttatgaaactcaactttattaattgattccggcttattgtcatggataccgtttctgcgaaggctttgggttgccattgtgctatttttgggggtgatggtttcttcaaccaaggtgttccattcattacagttcgggcaacgtcccaaatatcttggggaaatgtagccgcagttttgacatacaaattgggttttaacttttgccaactaaattctcctcttatacttacactatcaatattttagcactttatgaatcaaggttgacgaaatgccggcggactttacatcatcttataaattattgacctgacgaaccaaaaccaccgcttcgggtctgttttttgcgttggtcgtcctggtccgccaacagatatggcaggaaaataccttgggcaatccgttcgcccttcttgatcttaatgtcagtgatcccaaagttgaggatctgaacaaagatttcgccctcattactttgattattataataatcagaatcgatcacgccaataccgtttggaatcaccaatccacgttttaatgggttgctggatcgattggcaatcacgagcacttcatcaggctgcatataggacttaatccccgttggaattaggaatggcttaagcacttttttggcctcggcaatgctgtcttcccgaaccgttttctcatgtttaagtgcccaaaggactttcaaaaaattcaatttccagatcgatggaatcaccatatcggcagcactttcaaagtcatatcctgctgcgttctccgtcgttcggtaaggcaggcttaagttttcgtctgcatattttgagacaatttcaaatccacgtttcatatgtctggctccttctgtcaatatattctattattgtagtataaactatgtgaagctgtttgcacagattgacaaagatggtaaagtatcgcagtataatggtgtagtcaaacctttaaacaactttgaaatgagggaacaaatatgaaacatcaagacgagttgaagcagtctgtggggaaggccgctgttaagttcatcgaagacggcatgaccgttggtttgggcactggatctaccgtcaaattcatggtcgatgctttgggcgaacgagtgaagtccgaacacctctcaattgtcggtgtcccaacttcagaacggacccgtgaacaggccaacagtctcggtatcaaaaccaagggattagacgagattgaccacattgatctaaccatcgatggtgctgatgagattaaccggaccttccagggaatcaagggtggcggtgccgctcatctttgggaaaagatcgtagcgattaattccgataagaacatgtggattgtcgacagcagcaaaatggttgatgagttgggttctttcccactgccactagaagtcatcccttacggcagccaccaactgcttaaacgccttgatgccaaaggttatcacccaaagtttaggatgaatggcgatcagtacgtcaaaaccgactccaacaattacgtgattgatttgcacttaggccaaattgaacgaccccaccatttggcacttgaattggaccaaatgaccggaatcgtcgaacatggactgttccttgatctggttaacactgtcattgttggccgtgaagatgggccgcagaccattcaagcccgctaattgaataaaaactgacaacagccggaaatgcgatcaaaacgattcgcagccggctgtttgccgtttaaaagcaccctgctcactagccctttttaataaatgagcgtaaaataagattctattaaggagagtgatcatttttgacagcagaaattaatttagatcaaatcagcaagtaccagaagaatcttgataatcgaaaagattcgaaagtgattgaacgggcagttacccaccagggcattttggaaagcagcgaagactttaccgctgaaggcaaaatgagcccggtattttcaatcgatctttcaactggaaaagttgctgatcaaaagcaaagtggtcgatgctggatgtttgccgccctcaatacgatgcgcattcacctcatgaacacttataaggttccggatgatttcgaattatcccaaaactacaccaacttctgggataaatttgaaaaagccaattatttcttggaaaacgtcttaaaaactgccgaccagccccttgattcacgtaaagttgcctggctgatggcaacgccacaacaagatggcggtcaatgggatatgctttgtgccctgattgaaaaatatgggatcgttcccaagtcagcaatgccggaaaccttcaacagtaatcgctcatctcagctcaacaagttcttgaacctgaagcttcgtcatgacgccgttgccttacgtgaattggttgctgacaaggcgtctgaggctaagattgccgaaaccaaggacaatatgatgagtgaagtataccgcatgttgacctacgcactcggtgaaccagccaccaaatttgacttcgaataccgcgacaaggataagaattatcactttgacgctggcatcaccccacaagaattcttcaaaaaatacgttaacttaaacttggaagactacgtttccctgatcaactcacccactgatgacaagccattcaataagacctacacaattgaaatgttgggcaacgttgtcaatggccggccggtcaaacatttgaacctggaaatgtctgaactcaaaaagttggcaattaaacagctgcaaaatggcgaatccgtttggttcggaagtgacgttggccaaagttccaacaccaaaaaaggaatcatggacaccagcctttatgcacccgacgaattattcgattcagatttgtcgatgtcaaaagctgaacgtttggattacggcgaaagcttgatgacccacgccatggtgattaccggagtcgatctggtcgacggccaaccaaccaagtggaaggttgaaaacagctggggcgaaaaagtcggcaccaaaggctacttcgtgatgagtgacgactggatgaacgaattcgtgtaccagttcgtgatcaacaagaagtacctcaccgacgaacagcttgaagctcaaaaacaagagccaattgttttgaagccttgggatccaatgggtgccttagcctaagaatttgttcttaaaagataaatacgacaagtcaggttatctgatttgtcgtattttttatggtctattaaattgcaacgaactactccatgaacgatttactgataatgtttaattgctcatcgaaatcgtatcgaatcggtttgccgttaggaacctccacgttggggatttcttcatctgaaatattttccagaaatttgatcaaggcgcgtaaggtacttccgtgagcgacaatcaattggttcttgttgtctaacaacttcggcgcaatctgatcaacccagtatggaatcaatctctgttgtgccatttccagactttcgcccaacggaatttggacaccataacgatcataacggggatcttcgtcccgcttggccaaaagcggcggcacaacggtaaaacttcgccgccaaattttgagctgctttgcgcctacccgttctttgactttaagtttatttttcccacgaaggccaccgtagtgacgttcgttaaggcgccaggatttatgctccggaataaagttttgaccaatttcatccaagacaatgttggtggtgataatcgcccgtttcagaaatgacgtatgaacgtcatcaaactgaatttgagatttggcaatcactttcccagcactgtgggcctgtcgaacccctttatcggtcaagggtacatcgctccagccggtaaaaatgttgtcccggttggcttggctttctccgtggcgcatgatgactagtgttggcacgtttacatcctctttactcaaattaatttgttcacaaataaattcataaaaaagatgaccgaagccaccttctaatcttctcaacctctcaagtcgttgtgtgaacagactcagtgtagcatttctcctaaagcttctcaaccaaaaccattagaaccggaatcatgatcagactcaacaacgtggtttcagccaccatgatggaagcatattcggaatcggcatgatacaacctggaaacaaccggcgcattggtcataatcggcattgcagactgcatgatgaaaacttgtttcatcatcaccggcatcggcgttggaatgaccaatagcgacataatgattggggccagcataaaccgcccaaacaaaatcaagaagttactgcggtcgaaatgaacgttcgttaaatcaacactattgatggaaattccaataaaaatcatggacagcggaatcgttaaattccctatgtaattaaaatcctgcatcaaaaaatcaggcagggtgacgtgcatcaataccaatacgacaccgaccatgaaaccaagcaaaggcggtgaaaaaaccttcttgagagtttgcttccaattaaatgaagcctcacctttgccatctttttggatcaaataaacccccagtgtccaaaagaatgtcgtgttggccatatagtagaccaacacaaacggcaaactggattttccaaacagcgccatgttaaccggcagcccaacgaaaacggtgtttgagttggaaaacatggacatgaacaacccagaatgcattttgggaatcttggcaaatttgaccacgaagattgaaacaatgtaaagtgacagcatcgaaacgattgggaaaaataagtcaggaagtgtggtcagcaacttcttggcagtaaatttttccataatggttgaaatcatgtaggccggtaaggcaacctgagttaccaggcgggcaatcatgctggtcatcttaccgtcaaaccaatcgtttctggctaacacaaaccccaaggcaatcatgatcaggataattaaaaccccagaaacagcattataaaaaacttccataaacattcctcaattctaaaaatcaataacaatgaattattataacacaattagaatccacagccggttataatttttggtataattgaacaagttggtcacaacagatgttacaattattaaataatgtttaaataaccgaagatttctgcaatcaagtccaaatctgccatatacttttgggagaattttttgtaaatgaggagtcaatatgccatcagataaagataacaataatgattttgaaccagtgtattctcgtcgatcggacaagaaaccccactataagaaaaagaaccaccgtcgaagaagaattatcggctggagtatctttttcgtcctgctgatcgccttgggcggtggcctggtctggggatacggcgcatacaagagtgccaagtcgaccttcaagaagacctacgattcaaccaatgttaccaaagctcgaaacgtttcgtcagtgatccagcaaggaaagccactatcaatcctgctattgggaactgatacaggtgccttgggtcgtcacgacactgggcggacggatacgatgattgtcgcatctgtcaacgcaaagaaaaagaccattcatttgaccagtattgcccgagacaccaaggtggtcgtccccggcgatacccagccatatgagaagattaatgccgcttatacaattggtggcgccggaacagccgttaagaccgttcaaaatctgctcgatattccagtcgacttctacgcgatcatcaacatgggcggtttggaaaaaatggtcaatgcggttggtggcgtggacgtgaccccaccactgacgttccagtatggggctgcaaatgtcgtcaaaggcaagaaaatccatctaaatggtcgccaagctctggactactccagaatgcgtgatgacgatccacgtggtgattatggtcgtcaggcgcgtcaacgacagattatcaagaagttagtcatgaagggtcttaacattacctcccttccccgttacaaatcaatcctctcgtcactgtccggcaacatgaagacggatatgactttcgacgatatgatcgccatccgggcaaaatatggcgacgccactcatcacattaagtcacaaacccttcagggagaaaacgcgatgatcgatggtctttcctaccaagtggttcctcaaaacgaactgctgcgggtctccaacgacattcggacatcccttggcttggctaagtcaaccaagcttcaaaccagtcaaacagataccgatgacggtcaaggggcaacccaatcatcatcgacatataatggctattaaataatcatgaaccataaaatagcggctcagataaaagccctttttttagttataacgattaatatctttgctttgaataacacacatcaccccactgccaaatttaaacctggcagtttcaccaacaaattcgttgctggcaagcgacattgggtgtttaacctgataatcattcagctgatatttttcatcaaacaaagttaaatgatccatcggcgttaacgccacaaaggccaaatattttttatcaggttctttttcaatctgataagtccctggcaaaaagaaagtaatcgtattttgcttgtcaatcattcgaattttcggtgcgtagggcttgaaccggggctccaaaaccatccacagattggctagaaaatgatccagccgaccacccgtcgcaccgtaaatgtcaagtcgatcggcgtgatgttcctgcaaggcgaccttcaaccccaattgggtatcagtatcgtctttttcaggaattgattggcggatatccttaatgtggtcacgaaccaattgaagttctgccggttttaaggaatcaaagtcaccaatcgcgacaagtgggtcgattccccgttcaatcaaatggagattgcctctatcgatgccgatccaatcacctttaatctgtccatttttcaattcgtctggccagaggtcaatggggccgccaaccaatagatttaagatcttcatttatttggtcgcatcctttattgctttgattcggctaacaggatcatcggcgtcaaaaacgtatgatccggcaactgccaccgttgcaccggcttgataggcacccacaaccgtgtggtcattaacgccaccatcaatttcgatgtcaaagttcaagccttcactttttttcaactcatcgagttctgcgatctttttaaccgtttcaggcaggaacttctgaccgccaaatccaggattaaccgtcattaccaagacctggtcaaccatgtatagtactggcttgatggctgataccggcgtacctgggttgatgacaacttcagccttgacccctttgttcttgatcatctgcaaagcccggtgaatatgaggggttgcctcaacgtgaactccgatgatatcggctcctgcatccgcgaattggtcaatgaaacgttccggttgttcaaccatcatatggacatccaagatcatcttggtgatcggacgaatggctttgacccacccaggtccataagataaagcggggacaaactgaccgtccatgatgtcgatgtggagcacttctgccccaccctggtcgactttttcaatatctttttgtaaattgacataatccgcgctcaaaattgaaggtgcaactttaatcataactaacttcctcactttttataatttggtttccggtttttaatgtcggtgtacaactgcagataattctcataccgactctgcatgatctcaccgctggccacttcttttttcacttcgcagtccggctcattgacgtgcacacatccccgaaagcggcacttcacagatgcccgcttgaactctgggaaataattggcaagctggcggtaatcgatctccaaggtatcatacgaggaaaatccgggagtgtctgcgatatacccatctttgacccgcaataaagcaacttttcgggttgtgtgttttccacgatttaatgccgtagaaatctcaccggtagcgagctgcaaatccggtgccaagtgattgagaagtgtcgatttgccggcacccgtctgtcccattatcacattttcttttcctgaaaacaattgccgtaaatggttcaacgaattttcatcaaacgcggcttccggcagaataacgtcataaggaatgttagcgtaggcaactgctaaatctttaaaataattcagttgtttttcagataacagatccgtcttggtgaaataaatgatcggcttgatattggcaatttccaatgcaatcaactgacggtccaataagttactggaaaactccggctgagtggttgccgtcgtcacaatcgcctgatcaatattggcaatcggtggccgaaccagagaattctttcgtggcagcatcttcaatatgtatcctttgtcgccatcttcaacttggaactcaacgtcatcgccgaccaacggtgtaatttgacgctttcgaaaattccccctggcgcgtgttcgataaaccttgccttctgagtgaacatcataaaagccactcaaagactgaaaaatctttccctgtttcaattgatcacctcgataaaaaatcacttcccttacattataagagaagtgactttgttttgcagtaattattaatgtgaatcgtaggtcacgttgttatcacgcatgatcgtccgaccatcgcggaccactttgtattgaccgacttcattgccagacaatttaaatggcaaggtgacttgcgtatcctttgtgatcaccatctgcttgtaaaccgtcgacaaactatgatcatggtctttgagataaatcaagaccacgttctcgttggaaccactggaactatctgtggaagcagcatcactggagatgccactttcattcaatgtggagtcagatgatgccgccgaactgttgtcgaggtacgggatgataattttaacattgaaactcttcaattcatccgaactgtctttcttaggcccacgagaaatccaaaccgcgacgttgccgccctgttgaatcgattcgttggcatttggtgattggcggacaactcgccccttgggctgatcgtcagagtagacataatcaaaagttgggttaatttccaccttgttagaatatgagaccacttgagccttggtcatgccggttaagtctttcagcgtaatccgtttaacaccggttgaaaccacaaaggtcagtgtcttggtagccggattgaaccgtttgccggactcaaagtcctgttggagaattctgcctgagccaaatgaacttgaaggagcgttacgccgatgaaccgtaaacccttcgtcttccaatttctgtttgacaacatcatattcttgaccgacatagttgccgacccgaacgcgacgaggcccggaactcacgaccaaattgaccttggtgccctttttgactttggtttcttccttgggactggaactgatgacgcgatgacgatcaatcttatcactactttgatatttgacactgccaacggtcaaattagcggctttaatcttggcttccgcctcagtttccaacgtcccggagacaattggcaccgtggttttcccgttagctgaaacaatcatgatgaaggccagaataattaacagcaggccaacaatcccaccgataatccaccatcttcgtcgccgttttttcttcggcggctttggtttgtcgttcgaggtaccggcaggcttttcctcgcgtttagccggattggcatccgctgaggcagtcgtatcatccaatggtgaaaatggcatcacccgggttgcttcatcaaccgggttttgtggcggctgaaccgtaaatttaggttcattagcccgtgacttgtccaatgacgtattcaaatcagcagccatttcattaactgtttgataacgatcatcgggattcttagcggtggctttcaagacaacattttccattgcctggggaatgcgcggatcgaaatccctgactgaaggcattggcgtttgtgaatgtttaatggcaattgaaacggcggtatcaccgttaaatggcactttgccggtcaagatttcatagagaataatccctaatgagtaaatgtccgatctggcagtcgccatctggcccttaatttgttcaggggacaaatagtgaatcgagccaataatcgaacgagtctgagtcatcgtatcttctgtaccggcccgggaaattccaaagtcggtaatcttaatataaccgttcttatcgaccaaaatgttttgaggctttaaatcacggtgaataatattatgccggtgggcttcactgacagctgagcaaatttgctccataatattgacaacttcggcatagggaatgggaaagttgtccttgatgtatttctttaaatcttcaccgtcaacaaattccatgaccaaatactgcatcccctcaacctcgtcaacatcataaatgccaacaatgtgaggattatccagttgggtcgccgccattgcttcatgctgaaagcgcttcttagctttggggttgtctcggaaatcaagtcgcaacagtttaacggcaactttccgcttcaaaatgaggtcttcggccaggtatacgtcggccattccaccctcgcccaagcgaccgataatttcatagcgaccgtttaatacatagcctttattcatcggcggtcacctccgaatcgtattgggcgatcaagacagtaatgttgtccaagccgccattttgattggccaaggacaccaacatgtcacacttagtctgtaattcttcatccattgacaaaattttttcgatgtcggcatcgtcgaccatattggtcaaaccgtcggtacagagtaaaatttgatctccaggttgggcggtatacggtttgaagtcggcggccgaatcgttgttgattcccagactcttggtaataatatttttgtatgggttggttttggcctggtctggagtgatatcaccgtgtttgaccaattcattcacataggaatggtcttccgtgatctgagtgaattgcccgttggaatagacataacctcgactatcgccaatgttggcgatcagactctgtttgccatcaataagtgtcgccacgatggtcgtccccataccatggagtcgtgtgtccgtgttggattcatcgataatcgcggtattttcttttgccaactggttttcaaaccaagtttcaattttatccaggctggaaatactggtcgtttcaaaagcggctcccatgtgggtgacaaccatttgagaagcgacttcgccagcattattgccgccgattccgtcggtaattaatgccaaaatgaggccggtttgatttttgaacgcgccgaccgcatcttcatttttgtcgcgaacttttccagttgaggattgatatgcaatttgcaaattgatcaactccgttatgatttccgaatgagggagcaaacaaagaagccgtctgaatcatagtcatcggggtagatttgaaccatcttgctatccggattcaaatgattggcagtctttgtcttcgtgatttcaaaattagggttctcgctgataaacttggcgatcacgtcttgattttcctgtttaacaatcgtacaggtactatatgtaatagtaccaccagttttaactttagcggaaacggcattcaaaatttgtaactgaatctcacttagacgattgatatcagcaattgttttgtcataacgaatctccggctttcttctgaggagtcccagcccagaacacggtgcatcaactaaaattgaatcaaacaagccgtcttcaaatttggtatcgactttgcgggcatccaattcaaaagtttcaacttgcttgtagactccgagacgagtggcatttcgctggacggtctttagtttgtttttatgaatatctaatgcaaagactttgccggccttcaaacggctggcaatttgggtagttttgccgcccggggcactgcaggcatccaaaacgttgttatcaggggaaatctgcattgattcaactggcagcatggcactttcatcctgaatggttaacaggccgtcagtgaaaaagtcactgtgaatgatttggccatcgttaataataatcccttcactggaaacttggctgggttcggcatcatagccgtccttggccaaatctgccagcaaatctttttgagagattttggctaaattggcacgaaccgattgttttggcgctttattcagggatgctaagattgaagccgtttttggcttgccaagttgttcgtcaagcatttctaccaaccaggttggcacactatattcaatcgatagtcgggtcttttcgtcctgaatgtcatccaagtttggcatcccctgccgatccatttgatgcaaaataccggtcacaaatcggcgggtgccgtcatggcccatctgcttggcaattttaattgtttcatcaaagattgcccgcttgggaacccgatccagatactccaactggtacatcgcggtatagagcaactctttgacccaggcttcagtcttttccggttcacgcaaaaacggccggagttgatattccagcgttaatcgatgctgaatgaccccgtacacaatgttggtgaacagtcctttatcagctgggcccattgaagtggattgaatcacggcattaatctgcagatttgaatatgaaccattactggtgcgaaccaacgtcatgactgcaagttggcgtggattatttgttgtatatttcatttatttaatcacctgttggccaactttaagtgactgaccaatcccatttaagtaatctgttatttgttgttttggtttgccggcgggctgaagctcctgaatggataaaacagtgccttttcctgctgacaataataattgatgcttggttttctcaaccactgatcctggcgccatttcagtggtttgatcgacgacttgtgcccgccaaattttggttcgtttaccgttgataaccgtataagcgaccggatccggccgcagggcacgaactttggcgttaaccataaacgcggtttgattgaagtccagttgctcttcttccggtttgatgttgggtgaaaagacgacttgatcctgatcttgaggcactggggagatatcgccggtgatcacttttggcaaagtggctaacagcaggtcgcggcccacgatactgagtttgtcaaacatcgtctcggtatcatcatctggctgaattggaaccgctttttgtgccaaaatgtcgccggcatccatctttttaaccatgtagatgagactgatgccggtttctgaatcaccattcataatcgcgtactgaacaggcgcgccaccacggtacttaggcaaaagtgagccatgaacattgacggccgcaattttgacggcgtttaacatcttcgtcggtaaaaattgaccgtaggctgccgtgacaatcaagtctggatgaaagtcaatgacccgctgcatttccgggctcccactaagtttttcaggttgaaacaccggcagatgattggcaacggcggcttgtttaaccgggctttgtgaaatccggtgtttccggccgactggtcgatccggttgggtgacaacacataaaatatcgtatttttgatcaagtaatccttgtagaattgggaccgcgaactgtggcgttcccatgaacacaactgtcgtcaaatttatcgtttcctttcgtgattcaaattacataaagtccagcggttcattatcaattgcaatttggaggccttgacgttgctttttttgtgactggactaaaatctcgtctaaagtggcctttaactgaggttcctttcgatacttgataatgatttggtaatagtaacggttgtcaattcgggtaatcgtttttggcgttgggccgagaatgattgcctgtggggatagctgcttttttaaaaagttcataatcccaaacatctccgaagccgtttgattctcactgggagaattgccggttaacttaactgtatagtagtacggtgggtatttgccatcgtggcggacacgcatttcggtggcgtaaaacttctcgtaatcctgcgttttggccaattgaatcgcataatgatcagggttaaaggtctggatgatgacctccccggttttgtcggctctccccgagcggcccgagacttgcgtgaggagttcaaaagtccgttcacttgatcgaaaatctggaaactgcaacgctgaatctgcgtttaagacgccgaccaaggtgacttcaggaaaatccaatcctttggcaatcatttgcgttcccagcaaaatatccgccttgtgggcgccaaattgatcaataattgcttcatgagacccctttttacgagtggtatcaacatccattcgcagaactctggcagttggaaacatgtctttgacctgttcctcaagctgctcactgcccatgccataaaagcgaatccgtttactgtggcattgtgggcagacagttggcaccggttctttgtggccgcaataatgacaattaagggtatgtgtatttttgtgcatcgtcagcgaaatatcgcagttggggcatcgaggaacgtacccgcagtctcgacacatcaaaaaggcagaataaccgcggcgattcagcaataaaatcacctgctcatgtttgtcgaggcgaacctggatcgcatcggccaattttgtcgatagtgcactgtggtgttttgccagttcagttttcatatcaataatcgaaacgtgcggtaaagcatgctgattgatgcgatgcggcagctttaacagtgtatagacgcccttcattgcccgtgcacgggattccagcgatggagtggcacttcccagtaccacggggcaattattataggcagcccgccatttagcaacatctcgggtttggtagcgagggttgtcggcttgtttgtagctgctgtcatgctcctcgtccataatgattaagccaatattgctgagcggcgcgaacacagctgagcgaaccccaacgaccactttggctttcccttggttaatccgctgccattcatcgtagcgttcgccggaagacatcgcactatgaagcatcgccacttgatcaccaaatcggctgcgaatgcggccaacaatttgaggggtcaaggtgatttcgggcaccagcatcaacgccgtccgcccaagttccagcgcgtgggcaattgactgcaggtaaacttcggtttttccagaaccggtgacgccttccaataaaaagacctgatcttttttgtggacgaccgcctgttcaatcgaatcgactgctgcttgttgatcaggttgtaacttaaacggctgactgggggcgacatctctgagaaatgggttgcgaacatggcgcttcaatgttgaagccacccaccccttcttttcggcagctttcaaagtggcgctggtcactccaagggatgcccatttggaaaccagaagtgtttcgttttgatgggtcttgagcaggtttaacaattgaatttgtccacgagcatttttccgtacggttttgagggcgtcatcaatctggacgtcatttaattgacctcgataagcttttcgcataattggccgggcgcggttggtgagatcatactcaacttgaatatcgccggctttctgcagatttaaaatctctgctaaaacctgattattatatttctggcggtcatattcgacttctggctgtccttggaagatttccggatactgctggcaaacttgttcatttttggcaattagtttcttttggttcttagtccgcattccacctggaagcatggtttgtaaacagctgattttaaaggaataggtttgatcagccagccactcagccaatttaagtaactcagaattaacgactgggtataaatcaatcaggtcggcaatcggtttgagtttgccgttgaagctggaactgtcggaaagaccaaccacaaacccagtaattttgcggttgccaaaaggaacctggacgcgcatgccaggttgaatttgatccgctaaatgatctggaatcgaatagctgaacggactgttggtttggcgtgctgggacgtcaacaataacttgagcaacctgcaaggcagattctcctttcactgattttgcatttgtgtggcaataatatcgattaactgatcggcaacctttgccttactctcgacattcgtcttaatttgcttgccgtcagcaaataaaaatgtcacttggttgttatcggcgttaaagccaatcccgctttgggaaacatcgttagccacaatcatgtccaaattctttgattgaatttttttggtggcgttgctgattaaatcattggtttcggcagcgaagccgatcactaattggccaggctgtttgatagtggcaatttcttttaagatatcgggatttctaacgagttccagggtcatggtttgattatcagctgtttttttgatttttttatcggctaccttggccggtcgataatcggcaacagcggcggccattaccaaaatatcagcgtgaacaaaggcttgtttgacctctgctaacaattcagccgccgtttcaactcgaatgaaattgacgccggatggcggggtaatcaacggattagccgcgatcaacgtgacattggcaccggcatttttgaaagcgttggccactgcgaagcccatttttccagatgaatggttggttaaatagcgaaccgggtcaagtggttcacgggttcctccggcagtgacgacgacagattttccggctaaggatccacctttcagctttaagcttccatcaacccacgttaaaatttcgctgggttccggcatccggcccttcccggaatagccctcggcaaggaagccttcagccggttccatgatttgaataccggcttgttttaagttggcgatattttgttgggtggcaaaattggcgagcatgtgagtattcatggcaggcacaacaaataccggcactgccatcgttaataatgtggaagtgacaatattatccgcaatgccattcgccattttggcaatcgtattcgcggatgccggggcaacaattgccaaatcagcatcatcagcagtcttgacgtggggaatgattgtcggatctttactgtcaaaatcgctggtcaatacggtattcttactgacagtttgaaatgccagcggtgtcacaaacttttgggctgcttcactcataatgacgtgaacatcgttgtggttcttcactaataggcgtaccagtgacagtgatttgtagacggcaatgctgcccgtcacaaatacggcaacgtttttgttttgaaacattcttccaccccgtttcagatttcattctttattgtaccaaatctaagacggataaaaacagtcggcgtcttaaaagttggctgcaccccagtggaaaaggcgattaacttcaaaatgatccccccggattgctaacgccgagtttcggccgggatcacaagataagctgacaacaggattggctggtatcatcttgtccaacaaagacaaagggactgccagcaaaacagtcgttttgccgcagtcccttaatgatcaatcttattcaaaatcttttgctttaggatcgattttcaatacaccagcagcaatttcttccaaagctttgccgactgatttttgtgatttgtagtgatccaataatggcttggcaccggcatccaattcatgggcccgcttgctggaaagcgcaattaatgaataacgggaatcaattttatctaacaatttatcaacagatgggtaaagtaacataattatttatctcctaacattgactcataatcgggcatcacccgagcaacttttaatcgttcacttctaataatcgacttgattcggtcaacagccaaaggaacctggtcgtttaagacggcgtaatcataattacgcatcatgctgatctcgccgacggcctttttgatgcgcttattaataacatccatcttgtcagttccacgaccaaccagacggtgttttaattccattagatctggcggagtcaaaaagacgaagaccgcatcaggaacattggcgcgaacctgcatggcaccattgacttcaatttccaagaaaacatccttgccggattccaaggtctcgttaacatattttaatggggtcccatagtagttgtcaacatacttggcgtactcgagcatttcaccattctgaatattctcttcgaactgctctttggaaacaaaataataatcgacaccgttcttttcaccgggacgcggctttctggttgtcattgaagttgaatattcaaaatcaacatcaggctcctcaaacaacgccttacgcaccgttcccttaccaactccggacggtcctgataaaacaatcaacattcctcttttagccatcgaaaaaatcccttcaattatttgtaatacctgctattatcgccctttttgccccatttgacaagtcccagggcactgattaagaaatttgcatttgggggttgcgttttagaacgaacgttcgtataatgaagctacaaacaaatgttcggggtgaacaaaatgcaaaacaaacaatcatatctctcagaaattaccaagacctttcgaaccaactatgatcgcttcttcgaaattgtccgtaacactcaccaaatcaaacaaatgccgactttccagctgaattatttcattcaacagacactcgaaaacaactttcccatcacgatcgaatttaacgatcaggataatgaacagaccggctacttaaccaaactttccgcagaccgttacctattgacttcagatgataatcatttcactcgaattgtgaagttgtcagaaattaaagcgattcgtaaatactaagattatatcagattatattttagggcttgagacaaaactgaatgttttgtcccaagcccttttgcatttttaggattaatctgggtaaacagtgcgttcaacagcagcttccaagtggatagcggaaattaatcatttatttttcgacggcacttaagatgctttgatcttttgtttttcctcatccgccaatttcaacagctcactagcatgttccttggttaacttggtaattgccgttccggaaagcattcgcgagatttcagcgacactttgggcggttgtcagttccgtaatcgtcgtggttgtccgattgtcagcaatctttttttcaataaagtcgtgatgatcactcatcgcagccacttgtggtaaatgggtaatacataaaacttgagatttttgtgaaatcgtataaatcttattgccaatcgcctgggcaacccgtccagaaacgccggtatcgacttcatcgaaaataattgatgtgacaccagcagccttggcaaacatggtctttaaagccaacataatccgggacaattcgcctccagaagctgacttgaccaatggcagcattttctcaccaggattggtctgaatataaaattcaactcgatctgcacccagccggtttaaagcacgattttgctggatattgacctcaaagaccgctttatccatgtaaaggtcggataactgctggtgaacggctttttcaagctttttagcccaccggtggcgaatgtctgagatcttagttgcctgctgaatcaaatcggatttgagcgtggctaattgcttatccaaatcgtcgctggcttcggcatcccccgacatttgtttcagttcctgtttgattttggcaagatagtccaaaatttgactgactgaatcaccatatttgtgcttgagttgatagatggtgttgagacgctgctcaacttgatccaaacggtcctgatcaaattctaaattactcaattgatcggaaatctgactggcaacatcttgaagcgcgaagaaagctccggatagattatccgaaatttgtttatattcaggatccaaatcttcaatgtcctgcatcgaactcattgccgatccgattgaatcaattgacccgctggcctcctcgtcgccgttaatgccttcataactagccaagagcgcatcatgaatcttttgaaaattgttcaaccggtctctttcagcgactaaatctgtgtcctcattctcatggagatcggcagcttcaatctctttaatttgaaatttgagcatatcaacccgttgagcccactgcttctcattttgatgtttcttttgatttagatcgcgcagcttaataaattgatcgtattggtcttgataagattgcaaaacacttgccagttcatcttcggcatagtcatctaataattgaatgtgccgttccggccgcattaactcctgatgatcattttgaccctgaatatcgacgatcgtttcgccgattcgtttgagggtggcaatattgaccatgattccgtttacccgacagctgttgcgaccattggcaaaaatgacccgctcgataatcacgttaccgtcactgtgatcaattccaaggtcatcaaggacgttgtaggtggggttatcatcatgaaggatgaagtttccctgaataacggctttggaagccccggtccgaatgagatcatgggatcccctgccgccaaccaagaggccgacagcatcaatgatgatcgactttccagccccggtttcaccggttaacacggtcattcctgcctgaaaatcaatatctaagtgttcaatgattgcaaaatcggtaattgatagttcgagtaacatgttttcaacctctcaataattctattcagttcccaacatactattgatctgattgcgcatattaatcgcatcggcttcggttttgcagataatcaagaccgtgttgtcatcgccgagggtgccgaaaatcccgctgtagttcatctggtacatcaaactagaaatgaccggtccactaccaggtaagactttcataaagaccaacttgtcttgagagtcaaccgacacaaacgaatctcgaatcgattgaaccagtttcttttcagtatcaatatttttttgcgtcggcaaactgtatcgatacccaccggtaactgaaggtactttgacgagctgcatatctttaatgtctctggaaacagtggcctgagtaacttttatcccctgcttatccagtagcgagacaaaatcttcctgtctttgaatattattacttgtcagtaattgtttgattagcctttggcgttctttcttacgcatcattacacccccaacaataaaattgaataaaaatacaggtttacgaaccctttaattcagaataagcgttctcgatgactttttcaatcgaaacatttggtgacatgactggttgatcatcagattctaactcaactaaaaattcaatattgccagcgccacccttgatcggcgagaaatcaaggttttgaactgaataaccgttggccacagcgaagttcagaattttttccaagacgattttatgcacagcgggatccttaacgataccatgcttgccaacattggccttaccagcttcgaattgaggcttaatcaaagccaccacatgaccatttttagtgatgatctgtttcagcggtggcaggattaactctaaagaaatgaatgaaacgtcaattgaggcaaactcaggctgtccatgggtgaaatcggccaacttactgtacctgaaattggtgtgttccatgaccacaacccggggatcctcccgcagtttccagaccaattgattactgccgacgtccagtgcgtagcttaatttggcaccgttttgcagcatcacatccgtaaacccgccagttgaggagccgatatccaacacggtcagccctttaacattcagatgaaatactttgagggctttttcgagttttaacccgccacgactgacatacggcattggcttgcctttaaggtgcaggtcggtatccacagggattttggttcccggtttgtccaaccgttcttcgttatcaccaagaatctctcccgccatgacggcacgtttggccttttccctggtatcaaacagtccttgggttactagtagtacatcgactcgttgcttttccatattacttttcgtccttatttttaaaatagcttgtgaaatcatttaacagactggtatcaatcgatagcgcttctctggcagttgcgagggcctgctgggcatcggcgaccgtctgattcagcatttcatatgatttggccaaaccaagcaaattgggatacgtatttttattagcgtcctggtgaaccggtttgccgatttctgcttctgtcccaacaacgtctaagatgtcatcgtaaatttggtaagcttcgccaaacttctcagcaaacgttaacagtgacttgcgtttttccggaataacccggcccataatcaggccagcttcaacggcatagcgaatcaaggcaccggttttgttgcggtcaagtttttgaagccctgacaacgatagccgggtgccttcaaattcgatatcgtcggcctgacctgaaaccatcccatgggggccggcagctttggcaagtgccaaagtcagttcagcttgggtttgactgtccaaatcattatccaccagccactgaaatgccagtggttggaggccatcacctgcaagagttgccatcccagcgccaaattttacgtgattggtaggctttccccgtctgaggtcatcattgtccatagccggcaaatcatcatgaattaaagaatacgaatgcattagttccagtgcacagctggtttttaagacggtctggtcgattgggtcgcccaaactcgccaataccgcaagcgtcaacaagggtcgtaagcgtttccctccagcgttgactgaataactcatcgctgcttccagagtcgtctgatccgtatccggtttgatgtcattttccaaaatctgattgatttttggaacccacaaccgttcaaaatcagttaggttggttgccatcgctatcatccttttcatctttaggtgcttcgaattccacttcattgccatctttgtccatcattttggccatggtgtgttcggccttggttaaggtgtcttgaagctgttcactcagttgaattccggttttaaatttggccatcgactcttccaaggaaacgtttccctgttccaattgattgacgatggtttccagttggtccattttttcctcaaaggtttgattgtcttgtttatcaggcatattatttctccttctttgcatttatctgattgacagaagcgttgacgataccgtcactgaaatggacatcaattgttttgctgctcaagtcggcaacccgtttgataaaatgtccctgttcgtctgtggtgtacgtataacctcgactgagaatcttcaacgggctcaagtggtcaagtgagccgaccaacatctgataatgttgggaaacatttttcaggttctgagttgttgcccggttgagtcgacctttgagtgttgccagtttttgctgctcttctctaatcgtatatgttggcgcgaccaaacgcaggcgcaatttaagatcagaaaaacgatcctttcgtttaccggtaatcttgtcagattgattatagagtcgctgcgtcagtagatccaaacgttgagcaaaagtttcgtaaatccgttgaggtgtcgtgaaaacagtggactgccggagtcgcttcaatcgctgtttgtcttgctgaacaacctggtaagtcgcattaatgatgcggttttgggtcgtcctgaggtcaactaacacttgatccaacctgggaactgccagttcggcagctgccgttggtgtcgcggcccgaacatcggcaactaaatcagcaattgtggtgtcggtttcatgaccaactgaggaaatgactggaattttactggcaacaatcgctctggcgacgttttcttcattaaacggccacaaatcttcgatcgatccgccaccacgcccgacaatgagggtatcaaaattgccaatttgattgactcgctcaatttgtcggacaatgtctgcactggcctcggttccttgaaccagggcaggaaacaggacaatttgggcaatcggatatcgacggcggacagtggtaataatatcgcggataaccgcgccgcttggcgaagtgacgaccgcaattcgtttgggaaattttgccagcggctgctttggcaaattgaataacccttcggtggacagtttttgtttgagctgttcgtaagcttggtacagctgaccaacgccgtcaggttccatctgttccacatagatttgataacttccactgggttcatagaccgaaatatggcccacaactaaaactttcatgccttcttcagggatgaattttagccggttgaaagccgatttaaacatgatcgcactaattttcgcgtgatcatccttcaagctaaagtattggtgggcattcgggcgcaatcgaaagttggagatttccccagtgaggtataccttagttaaatacggatcaacatcaaattttcttttaatatattttgttaaggcgctaacggttaaataatcattcgccacgttcaaggctccattctgctaaatcaacagtttgctgcatcaaagttgcaattgtcattggaccaacaccaccgggaacgggtgtgatgtaagaaactttgtcaaataaatcatcatagtcggtgtctcccactaggtgcccttcttcattaatattttgaccaacatcaataatgacggctcccggtttaacatcgtttttagtaacggtatgaagactcccggttgctgaaacaatcacatcagcgttcttagtatattcagtaatatcttttgttaaaagatggagaattgaaaccgaagcaccagcatttaacattaaagcagccattggtttaccgacaatggcacttcggccgatcatcaccgcgtttttccccttcaaatcaatgtgatattcatcaaacattgtcatcacacctttgggcgtacatgcaaccggatacttggttgaatcatttaagtataattttccaacgttaattggatgaaaaccatcgacatctttttcaggcaaaatggaacgggtgatttgtttttcattgatttgctttggcagtgggtcctgcactaaaatccccgtaatcttgggatcctgattgtactcctgaacaactttcagcaactcatcttgggtaatggtatctggtaattccctgacaattgaatagattcccaatctaacggccgtccgatgcttatttctgacatatcgctggctggcaggatctgtgccgacaatgatcacaactaacccgggagtgattccgtgttggtcttggagttgttttacccgttcgctcgtctgtgcgtttaacttctttgccaatgcttttccatcaataatcgttgccatctagaaaccgctcctttatattttcatcgtgagaaatcatatgtacaaaaaaatagatttacacatgtgtaaatctattttaccagttcttctaaagcatgtgacaaaatcccgttaacaaattttcgtgaacggtcgtcactaaatttttttgcaagttcgattgcttcattgattgataccttggcaggcatgtcatccacataaaccatctcgtagatagcaatctccaagatgattaaatcggttcgggcaattcgctcaagtgaccaactggaagctaaatacttttcaattgtatgatcgatttcagacttgtgttccaaaacgccagaaataagttgatgcaggtattctgggtagtcgtcgccatatttaccgctcgtcaaaacttggaagaaatccttccaatcagtttgatcgttggtatttagggcaaacagtgtttgaaacgcaatttctctgatctggtgtcgtgttaattccactattcctcaccattttcttcattgtcagcgaacggattatccggatcaatcgtactggtggttttttccggaatcacgccttgaacatgcacgttaacttcggtgactttcaagccggtcataaacaacagctgctgttcgacttgactttgaatttccaatgcaacttttggaactgaaacgccatagttcaagtatacatagacgtcgatcgttaattcctcatctgtgtatgtcaaattaacgcccttaccgtgttcttttcttcttccaagtaattcattgacactcgttgaaaatgagccacgcatccggttaacgccgtcaatttgcgatgcggctaccccagcaataatttccaggacattgggtgcaatctcaattttgccaagttcgggatcatttgaatgaagaatgatattcgtgtcttcagccattataaagcctccgtttcagatcaatcggctactatgcccgtgaaatgtaagttccatcggtggtattgatagtcaacttgtcaccctggttaacaaagaatggaacttgcaatgttaatccagtcgtcatagttgcgggttttgaaccacccgaagcagtatcacctttgataccaggttcagtggaagctacttcaagaacaaccgtattaggtaattcaattcctaaggtttcgttgccgtattgaataacttgaacttccatgttttcttgtaaataattcagttcgcttttaatttgttcagcaggaattgaaatttgatcgtaagtatccatatccatgaagacatgttgatcaccatcagcatacagatattgcattttgcgcgtatcgatttgagcctgttccatcttagcgcctgaacggaaagttttttcttgaacagcaccggtccgcaagttcttcagctttgaacgaacaaatgcgccacccttaccaggcttaacgtgttggaagcttaaaatccgccaaattgcgttatcgacctcgatggttaaaccatttttaaaatcagcagttgaaattgccattgttgttcctcctaaatgtaatgtaacataaatagattatataatactttcggtcaaaatagccaatgaaaatggcattctaatcctgagcaattaaaaagccgggatgcaaaacacgcgttttgtcccagcctctttaattaaactattgtgcttactttgcagcttcagcaactggataaactgaaacctgacgcttgtcgcgtccttttctttcgaaacgaacaactccatcaacgactgcaaacaatgtatcatcgttaccacgcttaacattgttccctgggtaaatatgagttccacgttgacgatagatgattgatccactgtgaactgatgagccatcagcagcctttgtacccaaacgacgaccagctgagttacgaccgttggcagttgatccaccacctttatggtgagagaagaattgtaaattcattgctaacataggtttacacctccagattaattgatttatttcgctgtgtttaacttaatatacttactataactttcggctatatcagccattccgttcgcaaaagtattcaaaactgcatcagcttgaatgcgcttttttgaatcgctaacaactggtacattgactgataaatagccaccattgtcatcgtcactgtcgacatcgacatccagtccaacaacctcttgaagaccgttaaccgttgtgatgcttaacacagaaacagcagaacagacaatgtcttgcccatattcacccgcatcggcatggccggtaatggtgaacccacttacatgaccgcgataacgcttaatggtcgccttaatcatatcagtcacctcaaagtaaattatgccttgattgaatcaataacaaccttggtatatggttgacgatggcccttctttgaacgtgagcccttctttggtttgtaacggaagatgataatcttcttttgacgaccctgtttttcaacagttccagttactgatgcgccatcaactaatggtgtaccaactttaactgaatcgccaccaaccataacaacttgatcaaaagtaacctttgcgccttcttctgcgtctaatttttcaacgtagattgcgtcgccttcggaaaccttgtattgcttaccgcctgtagtaataactgcgtacatatcttgtgcacctccttataagtttgcttagactcgccgagaacaagcgctccgatcactatcgaagacttatcagcttgaatcgagcggttgtagctgtggaagccacaattacaacgttactagtatacataattggcaggtgttcgtcaatagaaacctgatcccataaaaaaacaaccgctacccacggctgttttatttacgttgagctaaatgtctgccattggctcgcgtggtggttgaagaattggtaaaatactgaataatgccactaacgatgaaaatgaagacaataaagattacaaatcccacaacgtccacctcctaattgttgtgacagcagattgctgcacaactacattatccagttttgtcaacgaacgttcaaatttttgaattcaaccaactcaaattttaataaaaatgcaactttcttaaggaattcataatcatattgacatctttgccctaaaagactgattaaacattgactaccctgttaatatttcatataattgttattgttgatttgtcgcaatagctcagctggatagagcaacggtcttctaaaccgtaggtcgagagttcgaatctctcttgcgacattctgacgtcacatcaggcatttcgagatgtttgctaaataccttcaattcctattttaacgggattgaaggtattttttatttacaccactatttacgccgcactctaggaaatgtcaaaatatcagtccgcttacttagtgttatcaaaacggccgaaccgaagctgaatctcttcgtttcgaccgtttcttattatcttcaattaataatcctgatcctgccgatcttcattaatcttgtttttatctttgaaggcctgttcaatctcctgctcagtataaccgaaatcaaccaagccaaatttaagaaacagtcgccaggaatggctaaagctgtcaccgctgtgatcaaagtaagcgtcaaacaacatgcgttttaaggctaaatattgcttatctaggttatcttcttttttgaactgtttgattttgtccagatcatcctgcgagtttaaaatcacgtgattccaatttttgaggttggaaatcaataggtagaaatccattgcgtcaacgtactcatatagcaacgtttcccgcggcgttttgttgggatcgtgcttaccacgatgcgtcttccagaccttgaaccactcggaagtgttggccatttcagccagttccacatccagggccacaaaggcatttttcactctgccgtcatttgaccagtggagttgcttctttgattcgatctggcgattcaaatacaccgatgaagcaatcaatgattgtaaatccatttcaaactcctatccaaaaataaacttgttcgataaaatctcgagttgctttttgttatccaaataccagtctttgatgaacgggtaatccaataatagattcagccagctttctttttgatcctgatcgtggatggttgctccccacttgggccgatcttcatcaccggcgttataaacgttcagctgggtatcgttatccaaggtcaaggaggccccaccattttcaccagacatcaaaatatattggttatcagccgacttaacaaatagctcgtccaaaatcggctctggaattgcgccggcagcgaattcatagaactcaccgttaacgccgtccaagacgttaaagtcaatcttaaagccgaagctttctttgagcacttcagcagcccgcataatcacgttcatcgcatctttaagagccgaaacgtccaagccctccaaatcaacgacaaagtaatcgatcaaggccgacccatgaaacatcatttccttactcttcagattcaagtagaatagcggtcggttatgggccgtggggccaaagaagaatccggcagcattcttggtcgatttagtaaaagtaaaggtattatcaccaagtgatgaaaatttagccagcagcttttgaacgtgttcagagttgctaattgaaagtccatcggcgtggtcagacaacttcaataaccgttcaaagaataccagctgaacatcttcatcagaaaattggtgtggaaattccacaaaatctgaattgagttgataattggtcaacgaaacagctgcagtcaacaattcatcgaggtcctgggtctgatttaggctggtaaatgcattgacatacttggacccattgtccaatccggcttgaattgactgagtatagtgattcaaaagctcagtcgtcgttaaaacattcttttctgtttcagtattttcattactcaccgtcagtcacctgcgattctttgctcaagctttgcaagtatttggcgtataagttgttattgttctcaataaatgcttcaaaactgccaaatgaagctcgaatattttgtttttccaaattgtaaatggtctcttctttggacagcgccaaaatttggttttcattctttttgatttcggaccgggcacctgaagcttgttcatcaatattcgtcaactcaagcagatcgttttgtaattgctgatgctcttccttaaccttgccggcttcccaaggcattggcgacttctcttcattttccttaatctgcttgcgaatctcttccttacgctgatcacgtttggtttgatcttcaatcaattgagtcagtttttcgttcttttgacccagttcacgcatctgatcgtcgtttacccgtttgttttgagcttcaagttcaaatgatttggccaaggtattatattcgtcttcagcaaaattgaatcgaacgttaattgtatccaactccccaaacatccgatggtcccaccagttaccaaagtaaatgttgaatttccccaagtcatattcgtggtaatagaaaaatggataggtggttcctaaataatcaatgagtttgtcactcaaatgatgacttaactgagccttcagatcagcggccaggccaaagaaattagtctccggctgatcgggctgttcacccttgacttctgttgcaaagcggttgggatccatcaattcgtatacttttaaatcattgccatttttgatcgagtcattcaaatccgacagatattttaccttttcgcttaacgcggaagctaaaatcgagtcgttttggctgaatggatcgttttcaattttgttatccataatattgcctcgtattccccttatttatacatttaatgttatctgaaaaacgtacataaataaagggctaatcgcattatttatgaaagatttgtcaaaatgatgagaaaacaatccattcttttgaaaattaggtgaaatgacaaaaacgaccagaccatcataatgggttaatgatgacctggccgcctctgtattcgattgttttcagttgaaagtttgactctctttttccatttgcctatatggagttgtcaaacagtcccccgtcgctgcatgataacttatttgacaatgtaggcatttttataattgtacgttgccccggctgtattgtaaataatgcctttgaccttactgctcaacaggtttttacttgctgattgatatagcggtgtaatgccctggttgtccagtaagatattttgtgccttggtcatgtcctcaaatcgcttgtcagcgttcccagcatcggtggttgaagatgccttaatcaacttgtcatactgcttgttcgaccactgtgggacgttgcttgggttgccagacgttaggatgtttaagaaggtaatcggatcggcaaaatctgcgtaccaatcacccatcgtgacttggtaattatgtgatttctgtcgtgacagcaacgtttggaaaggaatatttcttaggttcaccttgagcccaggcagattcttttctagttgcgactgtagatactcactgacttgtttttgcgcgaattcgtccgaactgagcagtgtaaaactcattttggtgatccccagttctttgaggccggctttccaaagcgccttggccttgggtggattataggttaaagaatccggtttggcagtggtggctgtaaaatctttgccggtcttaggattaattgacagtcctttggaaacaaaactttgtgaattaaaggaaccgtctcccaaaatcttcttggttaactggccgcgatcgatggccatcgaaattgcttctctaatttttaaatttttgaacagtttcttcttttggttgaatgccaggtagtaacaactcgaagtttctctggtcaccaaattcttattgttcttcagatttttggccaaaacaccagataagccaacgtattgcagcttgtcggtcttaaattggttatagccggtcgaagggtccttagtcacttgatagtggagtttgtccagtttgacagctttcttgtcccaataattttgattcttggcaagcgtccaagtcatcccggttccgttccagctggttagcttgaacggtccattgtagaccatatccgcactcttcgtcccgtaattgtcgccaaacttctcaacgaccttttggttctgcgggaagaacaatgggaagcccattaacagtttgaagtatggaattttcttttccaaggttacgactagtttataattgccgtcagctttgattcccagtgaattgggtgactttttgttagcttggatggcatccgcattttgaatccctgaaaaaagataaccgtactgggaggccgtttttggattgacagttcttcgccaggaatacacgaaatctttggcagtaaccggatccccattgctccatttggtgcctttacgcaaattgaaagtatattttaacccgtcatttgaaatgttagttttggtggccagtgcattttcaattttgctgtccttacccagacgataaaggccttcatcaatgttgtttaacacttcaaatgtttgaaccgacgtcgttttggaaaggtcaacagttgagagttctgaatcgactgcagtggtaaattcctgtttggccgccagtttccccgaaccgctcttttgcgatgaacagccggtgagaattaaggctgcggagatcactaaccccacttttaagccaacttgaatatttgacataacagacaccccttcatgaatctatatgagactgaaatacattcaattataaacacattatattttaatgagagataatcggtataaaaagggctcacagcagtacaccatcgtgcaccaccatgagctctttcaataatcgatcacgctcttatcaagtgcggaaaagttattttaatacactaatacttttcaagatactggtcacgttcccaaccggaaacttgtgtgcggtatgaatcatattcaaggttcttagcttcaataaagctactgtagagatgttcgccgagggcctttttcatcgtttcatcagctgaaagatccttcaatgcattatgcaaggtatcaggcaggttagtgatgtggctcttctgacgttcttcagcatccattcgataaatgtttcggtcaatgctgtgttctggttcgatcttgttgcgtaagccatccaagccggcttccaagacacaagcgattgccaagtatgggttagcagttggatcaactgagcgaagttccaaacgagtggaattaccacgagcacttggaattcgaatgagcggcgaacggtttgaaccggaccatgcaacgtagacaggggcttcgtaaccaggaaccaaacgtttgtaagagttaacgattgggttacatacagcagtaaaggaacgggcatgcttcaagagaccgcctaagaagtaataggcttcttgagaaatttccaactcgccatccttgtcgtagaaagtattgcctttatcgttgaataatgacatattcaaatgcatccctgaaccattaataccactcaaaggttttggcatgaaggttgcgtacaagccgtacttgcgggcaacggtcttaacaaccaacttgaatgtttgaatattgtcagcagcagccaaggcatcagcgtacttgaaatcaatttcgtgttgaccaggagcaacttcatgatgggcagcttcaacatcaaagcccatttcttcaagggtcaagacaatttcacgacggcaattttcacccaaatccattggggccatatcgaagtaacttcccttatcgttcagatgaagggttggttcaccattttcatccatcttgaacaagaagaattccggttcaggtccaatgttaaatgaagtaaagccggctttcttcatgtcgccaagaacacgaatcaggttattgcggggatcggctgcgtatggctcgccgtttggacggtagacctggcagattactcgagcgattttcccacgatcagtactccatgggaaaatcatccaagttgataaatcaggatacaaatacatatcactttcttcaattcggacaaagccttcgattgaagaaccatcaaacatcaatttgttatcgaggagtttctccaactgagtgattggaacttcaacgttcttaattgtcccaaataaatctgtgaacatcagacgtaaaaatttgacgtcctcgtcttttaccatcttgcgaatatcatcttttgaataatcatgctttgtggccatctatccatcgctcctatcaatgatttagtttgtttaaattgttcaaattattcggatcatcaaatgacgaagaaggcggcttcaatccaccaatgttaagaaactcgtcttgaagaatttttctcacatcactgtcagtcaaacccttctcgagattacgcttccgctcgtcttccaattgattctgcttcttgtacacctctttgataccagagatattcagaccgtcatcaagataatctttgatttccaaaagccgatcgacatcattcaatgaatacatccgtcgattgccttcattacgaagcggcttaatcaattcctgctgttcataatatctgatttgtcgtgctgtcaagtcagttagcttcatcacagttccgatcggcagaactgacattgaacgccgtaattccttctctcgcattgttcacctcctaaatcttgtacccataataccattcccataatcaaagtcaagactaaatgtcacattttataacatgaatttattgattgttgtcatccagccatttttcaacgtcactttcaatctccgttaactgatttggtcgctgaaccaggttataccaatttggttgcgggtcagttttgttcctaaaccaagttaattggcgcttggcgtaatggcgtgaatccttcttgatcagctcaattgcttcttccaaggtcgattggccctgaaaatacgggaataattcacgatagccgatccctttgccggcttgaaattgctgtccgtcatggtcatacaaccagcgaccctcggacagcagtccctgcgccatcatttgatcgacccgctgattgattcgctggtataacaacgcccgatccgtcgttaatccaatgacgaaggcatcgtattttgatccggcattatgctgatcagaaaatcggtgaccggtgtttatgtagacttccaaagcccggacaacccgcctgacgttgtgaaccggaatggcccttgctgcggcaggatccactttggcgagtcgttggtgtagcgccaaatcccctttttctttggcttcagccagcaattgtcttctcaagtcatcattttgatactggtcgccaccaagttccagcccagataaaagtgcctgaaggtaaaaaccggttccaccgacgattattggcagcttgccgacttcgtgaatggcttcaatcagtttcgaagcatcctgaacgaaatcggcaacagaaaaacgttcgtcaatatttctaacatcaattaagtggtgtttgacccctgccatttcttccggagtaattttagctgtcccaatgtccaagtgtcgatatacctgcattgaatctccggaaataatctcggcgttaaatttttgagcgagtttgatcgacaaatccgttttcccaacggcagtcggtccgacgattgctaaaagtttgatcattccagtccctcccgcatctctgacctgatctgaacagctctggcaggatagtcggtgatgatagcagctaggttgcgttcaaaacagtactgcatatcctctgtggaattgacggtccaaggacgcagattttgagcaggggcaaaaaagggatgtcgtttaagccaacgaatgtccggatggaaatcggcaattaaatggtccttcttgagggttttggcctgcttagcggcagttttgaacaatttggcaccggctaatttagggtccagccggttgagaatttcaagggaccgggcattaaagctggagtaaatcagctgaaatgggtagtcgattgacgcaaaatagtcaaaaaccgctttttcaatccctggatactgaatcttgttggtcttcaactctaagttaaaaattcccgtgaagttgtctttaattaataattccaccacctcttggagcgtggggaccgtggttcccttaaattcactgctgaatcgaacaccagcatccaaatgtttaatctcagccagatttttgtcaacaattctgccagaaccgttggtggttcgatcaactgtttcatcatgcataataattaactgatggtcttttgaaaaatgaacgtcggtttccaggccgtctgccccatcgtcaatggcggtttgaaaagaaatcagtgtattttccggtcgggttcctttactgccgcgatgagcaataattttggtattgattttcacaataaactcctttttgaacgattaattaatcaattaactagatatctatgaaaaaataaagcataatgaaagtataaacgagtattggagggtttagatatgaaacagtttactaatgggctcattgttggtgttctcggaaccgttgctgctggggttggtgctttactaacattcaaaaagtcagttgtggatccaatcgaagatgaagagcaaaaattcgaggataaccgaaaaaaggcaatgcgtaaaagccgagctgcccaccacggataaaacattatccaatccattacactaatatcgattataaaaataggactatgaacaaaacgactgctttgttcatagtcctattttatcaataattactctttttttccttaccattccaaccttgataaccactttttaagatataaagatctttataaccctttttgcttaaaaagagtgcggctcgtttgctgatcgttttgccttgatcatacatataaaccggcaagtctggacgaagctgactgtaaaagtttttgatggttgagtaaggcatgttgcgagcacctaaaacatgaccatctttaaaacttttttgttctcgcaagtcaatgacctgagcttttctcatgcctttttgaaactcatcatttttcaaatacgttgcaacctgtttaacacgcatattttgaaaaatggtatagccaccccatgcaagtaaaataacgatcaaaatgatggttgtcaccagattggcggtgattgcaccgattatcaacaaaaacatccctctttctctcaaataatttgattatttagttccaaatggttgattatttctaaattgcaaggctaatgatgcggcaccaataattccggcatcattcccgagttgagccaacttcaaccgtgttgagtcacgaacagaaggaaaggcgttctcttggaaataacgagtcgttggttgaagcaaggtgttaccggcgttggaaacaccgcctccaataatgatgttttccgggttcaacgtgttaccaatgtgtgaaagtgccaatcccaagtatgagcagacccgatcaacaatttggttcgccaagatatcaccgttatcagctaggaagaagaccatcttcgatgacaaatcttcgtcgccatcaatcaattctttaatccgtgaatggccggtaaacttcttggccatatctttagcaatatggacaaccccggttgctgaagcgtattgttccaaacagccacgctttccacaggtacattgatatccattagggacaaccgtgatatgaccgacttccccggcaccaccgttaataccatgaaccagcttgccattggcgataacaccaccaccaacgccagttcctaaagtaatgaagacaacatcttttgccttgtcgccggcacctttccaatattcaccgagagcggcgctattcgcatcgttgtcgatcagaattggtaaattgagattggctgaaatggttgctccaaccggttgcacgatatcccagttcaagttatatgctccaacaactgttcccttttcgcggttcacagcaccgggagttcccatgccgataccataaaaatcacttgcgttatagtcgtcttttctcatttgatcactaattgatttgatcatgtcaggcacaatgtgactgccgtgttcactaatgttggttgggattcgccacttcgtcaggacgtttccttttgtatcaatgaatgcaaatttaactgtcgttccacccaaatcaattccgattaatttcttagccaatgtattttcccctactttcttgtttttcttcaattcgatgttcccgcgttaaaatcagtttggcatgaataaactcatcatgactgatcagcttggcatcatggagatggtccaactccaacgccatgacttcaatgtcccaaagtcgtttgccgacatatacataaatatcgaattttttcagcagctgctgaacatcatacagcgttttcattatctcacatcctcatgtaaatttctttcattttcaaaaaatttaaaattttgcccgcatacctattgtaaacaaaacgaaagcgattacaaccagcataattgccgaaataattcgtttggtttggctggtcttggaaaaaccgacgcccgtcacgtacgccacaaggaatccaccaaccagtccccccagatgcccagcaatatcaatgccggaaacaaaaatatcggttccgatatttaggataataaacaacaggaatgttttggccatcgaaacaattgccgggtttttggaaaaactttcccccagcatcataaaagcaccaaacagtccaaagatcgcagtactggcaccggcagacaagctgtcggtaaaagcaaaactgcccaggttgcccatgatgccggaaacaaagaagataaccgcaaaccgccagtgtccaaacaattgctcaacatactggccgataaagtataaggtgatgccgttcattaagatatgggtgaagccaatgtgaataaacattggcgtgatcaatcgccaatactcgccggcacggatgagtgggttgtatttagcgccgaattcgaccaaggtgacggggttttcagttccgcccattactgacatgatcgcaaaaaccactaccatgatgattaatagtccatatgtgatataaggctgatttcgtaaattactcatgaacccctcctgttatccgtttagtaaatgagtttgtcgactttaacgtcaaaatcttccacgttccagacgggttcgtcaaatagttgaaccggcgtcaccaaagcgatacttgtgccggtaaagcccttcaaaaagcgatcgtaaaagccgccgccaaacccaactcgaaagtgatttttagaaaatgccaatcccggtaccagtaaaacatccagctggctttttgccagcacttgaccgccaacgggctcaatcgtgccaaatttggtctcactgagtaccgtatcaggttccagcagcacaaaggtcatctggcggtgcggaagtgttcggggaactgctacttgtttatcatgggttaacgcccagtgaataattggctgggtatcaagctcatcatccatactgagggtgatccccagcgtctcactattcgcaaagtgtggctcagcgaataactgctgatacaagcgttgaatttccggtttttcttgtggatcttgtaaaaagtcatgaagccgagcgatctgctgatctcgcagggcggcttttaattggttacttttggccatttacctcacctgattcttcagtcaaatctaattgacagactctgttgtatataaaaaaggtttgggtatttacccaagccttatttggtttctcgatgtaatgtaactttacgctcgcgtgggcaatactttttaagctccaaacggtcgggattgtttcgacggttcttgctggacaagtaagtacgttcgtggcattcagtacattccattgtaatgtgtactcgcatggaatacgacctccaaacttttatagagtagctagtctaatagcctcaacttaaaatattttatcatcaatcctgataaattactaggacaaaatcgataaatgttaagtgtttttacttaacagtcgaagttgattggaccgtcttccagtaagcagagtagatttgtttggccagcgccatgttattactttcagcgttaacccccaggttaggcattgccaaagcaaccaccacctgtggatgagtcgatggcgcatatgaagctaaactcagggtaactgtttcgttaccattataaaatgtctgagcagttccagttttggcagaaatttccggtttgatggaatccaacatcccaccggtcttgtaggtgttggttccatgaaccacccgatacaagccggttgtgaccacgtttcgttgcgcttgagtcatatcaatatgattgagcacctttggcatcactgtcgctttaaccgttcctaatttaccatcttggctggtgccgcgaattgcttgaacgacatgcggttcaattcgattaccaccgttggcaatggtagacatgtactgagcaacctgcatcgttgtgtaggcgtcgtagttaccaaatgaaagatccaaggcacttccaatgtgcttatagccgctggcaccctgtaacccggtagattcaccagggatatcaatcccagtcttgacccccaagccaaattggttgaagtaaccgcgcatcgtgttgaagacgttgggactcatggttaatgcgccaccttcaacatagttgaagtggccttctttcatcgctaactgcatcatataagagttggaagaaacttgcagcgcatcactggcatcaacagcaatatttgcatgaccgttgtggttgaaccaagacgactttttaacaccaccggtcgtaattggctgatcggttaaggtactgttggttggtgtaatgacatgatccatcaatgcaccggaaaccatcgcacccttgacaacagaacccataacaattgagctgttaatggttcctaaaatattatcagtgatcttggatgtcttcggattgcggtcaacccccgccattccgatgatggcaccgttattcggattcatgacgaccgcataagttccggttgaattaccaccggcaccggactcggcagaacggactaaggattggagctgcttttggaatttggcattgattgtcaattgaaggttgtcacctttttgaccgccatatttcttaatttcctttttgatctgattatcgctattcaaaatgatttgggtctgggatttggttccccgaagaaccggttcatactggcgctccagataactttgaccgacactgtcgtttcgtgagtagccttgtgccaataattcattgacccgatcacttggcagaccgctcttttcattcgagacagttccggtgattccctgaattgaacggccatttggataattacgactccaactggttccaacattaaccccaggcatatcggccagatgttcccccaccatggcaacttctttggtggagacgttgtcatccttaatattaacggtggataattggtaggcaccactcatcttggcgaatatggttgcagcatttttgagtgctgatgaaaaagtggcatttggataactttcaaccttattgacagccttgtcgtatttggcatcctcagaataaccggaaatcccagggattgacttttcgactttggctagattatctgtgtttgccaaatagtaatcagccagctggcgcttggttaaactgccggtaggaacggtcacatattgggctaatcggttggcggtcttgtacatgtccgaggacaacacattcacgcccttggtatagataattgcttggtgcgcggaattgccgactaaaacgtgtccggttgaatcaaaaatcattccccgctgaacattcccgttgaccactgaggtatccgaacggttcacttcggctttaaatttagaaccgtacatcacctgtaaataggccaactgggtcagtaatgcgacaaataaaattccgacaataataaaaataatattaattcgaaaaggcagtgaaacagcctttgctttgttcgttttcttggtgcgctttttaaaaattttcacgatattaactccttgccatgaaacttattctatcaaattttccaactaaaaactacaaccggtagtcaatctttaacttattatgatattctatatgttgttaatcacttttaaaaaggatgtagattatgaattcaaagaagacaacgaaaatttccatattagtgctgtgctttttggtaccggtgctaatttccaccagttactttattttccgccactttgctccgtttggcggctcgtcagtcatgaccgttgacctgggccaacagtatattgacttttataccaatttccacgacaccctcctacatagtccaagcggctttttcttttcattttcaaaggctcttggaggcgacatgatgggaacttgggcttactacttaatgagcccgctgaacttgattatgttgcttttcccactttctaaattacccagtgtcttgggcatcatcacgattatcaagtatggtctggctggtttaagttttggctatttcttgatgaaagttaccaaacacgttggctggtcaatcattggtttctctgcttcgtatgcgatgatgggctggatggttgccaaccaattcaacatgctttggacagatgtgttgttcgttttgccaatgattttctatgggctcttcaagatcttgaaaaatcagtcgagtgccatctacatcatcagtttaacggccatgttgattatgaattactacatgagttacatgatcgccatctttttaaccctcttcatgttcatttactgggctgccaaggcattgccggtggaaaaccaaacatcgaccaaagccgttctcagatggcttaaggcgtcaattctgagcggtattttagctgcctggctgctgctgccgacctttttctcgcttctgggaagcaaaacccaatattcaaagggccaatacaaaatcaagtttgaatataacccactggacatgttgggcaagttctttaatggatcagttaatttcaatgaactgcctgccggaacagccaacgtctttgtcgccagtgtcgttttgatcctatttgtttactacttctttattccaaccatcaaacgaaacgtcaaaattgccaatctttcgttgacagcatttatgattctatcaatgtgtttccaaccactggatctgttctggcacggtatgcagctgccggtttggtacactttccgtttctcctacctcttctcgttttggatgattctgaccgcctttcaagcctttctgcatatcttggatgaaggcatcaactggaaaggttatctggtcactgccggtatcatggctttgggcgttctttacgtcgaactccgctggaagcatctcgaatacatgcgccacttcgactttctctggggctgtgtttatttggtcgtttcccttgggatcgttgtcttcttaggcatttatcgcagaaacattgttctggcgatgaccttggccgtgctgatgagtggtgaaatggcccttaacatggtcacctcactgaatcatcttgattatttgaaggccagcaattacacccagtttgagcgggtgatgcgcaaacatgtcaataagattaagcaaaaagataagggattctatcgattgggaaccactttctcgcggaccaagaatgacgctttcactggtaattacaatggcggctcaatcttctcgtcaaccctagaatccgatacgtctcaattcttcaaaaatatcggtcagccaaatggggattcatttgtcctttactcaaacggaaccatgtttactgattcattgttgaacatgaagtattacatgagccaccagattccggaagctaatccgaacaagaaaccaaagaagcagctgttgactactttgacaagaaaaccagattacaacaattacaccttgttgtcacaggacgccttgattggtacctaccggaatccgtatgcggtcccgattggtttcctggcgcctaaatccggaatggaacataattcaatcgccaagagcccgatcacttaccaaaaccaaattgcccatcgtctggatccaaacatcaagaacttgtttgaaccagcaacctacactgacatgcggtataacaacattcaaccgatttctcaattagataatgctgtcttgaagaaaaagaacctcttggaaatgtcctacatcattttctctgtcccaattgagaagaacacgtcttactacatgacgttgggaaccgaaatcaataaaggcaacatttcaatttcggttgatggtcaagcgcagactcaatttacaccatctgaaaaaaccatcattgctaacattgccacaggtaccagcatcaataccactgcaaatgttcaaatctttgtcaacaagaataacgccctcttacaagacgtgaaattgtacaaagtgcataattcaaagattgctcagttctctaaggacttaaacgccaagccgtataaagttacgaagtggaaccaccatcagttaaccggaacggtggacgtcaagtccaacaatcaagcattgaccacgaccattccatttgagaatggctggactgctaaggttgatggtaaatcagttaaaccaaaacgctgggcaaagatgttcctgtatatcccaatcaacaagggtcaccataaggttgtctttacttactggcctgaagggctgagagtcggcctactaatcactgcttttggcttagcatttatcggcaccgaggcaacgttaaaacatcgtaagaaacaaaaagccaagcacactgagacaccaacaaataccaaataaattgcatgattaaagggatgaaaaccattttggcttccatccctttttggttggttacgtttatttatcaagatccccattaggtgtgtacgtgtacacaacattttcaggatctttttctggattaaaatcgactttcaaatcaaagccgacaaagaaccagcgatcatcctcgtcaacgaaataagtaattccgtccttttcagttttggtataagtctcacctggatgatcatcgcgggttaacgctaacgagaagccttcatggacgggagtcttcccataaacctttccatagaagcgcacaccattgccttggcttaaccccatttcagattggaaccatttgcttgcggaatcagttacatcaattttcattattatgccacactcctaaaatctgtgtttgtattcgcttacaatcgattataacatcattaaggtatttcacaaacgatatgcaagccgattagacactgacattgttcatcaaggggctcttcacctttcaaaacgtgacgattgcgggcttaatttaacttatcaaaaaagaactaaccgttgagcaaagatgctcacagttagctcttttaacaaaaaaagcattcattgctgaatgctttcatttgtttagtcttttgggaatggtatataaggtttgttttcggtattggtccgaataaccatgacatcacacttggcgttgcggtcaacaaatgaagaaactgatccttcgaggactcgctgcaggcgactcataccggtagcaccgatgataattaaatctgatttgtggtctcgtgggaattccattgaaataacggtcttaggattaccaaaacgaatatggattgaaatatcatcaaggccagattccttcttaatccgatcgaccagtttgttcagataatcagtggtatcttcaacaaggttgttaataacgtccccatcgaccattccaccatagttataaccgtattgttgtgtgctcaaaacgtgaagaacatcgagatgggcatcattattttttgcaaattgtgcacctttcgccaatgcatcttctgattgattggatccatcgactggcactaagatggttttataattggattccatgaagaaacctcccacaaattaatttaagttcattatatcactaattattccaccgaatggcgcttaaaaactgaaatacagaatcattttcagaaaattacggtttacttggaacaatgaattcggcagtttcaaggatatgaccgcgcatggcgtcctgtaattcatttaaccagaagccgtctttcaaaggcaactgggtgtctagtgcaaagactgataaatgatagttgtgaactttgtcgggtgggttgggaccattatagtgccaggcagtcgtctgattggtgttgccaattagcccgccggcagtgctgttgcgtccttgaatcattggaacccttaattgctgactgttattttcagggatttccgtgacgtcaggggcaatgttggcagcaatccagtgaatccatggaaacccgctaaccggaaccgcgtcccagtccaataaagtgagtgctaatgattgcgcgccctttggaacgttgctaatttgaattggaaatgaaacgatcggcttaccgtcaagcatgtcgtttttggcggcatacttactgtacttatctgctaagagaccctttgttaaaggaacttgtatatccatatcgatccctcctccatctcaatgatatgtcttttaatcgtagaataaaataatatgaatccaactatttgataaaccgtaagacatagtatccctgtccgttcgatgtaatcgtgtagttgacgtaaccagccttcagccattgctgcttggtggcatttgcccagttcttggcatcctgaacagaggcaaatgtgtgggtgcttgagaattggtcaggagctttctgtggcttagccggtttatcacttttgacgccgttcaagaggttttgctcctgggacttgacggattggttctgctcttcgttgatggtttgctggaattgctgacgttcttttggattgagtccattttgctgagcatccttgagcttactgctaaacgcattcacccgattcttctcaacttgggtagtcagcgatcccttcttagaattgccggacaattctttctcggactttttgatggtcttgctgatcgaattggttgaacttccttgtcgatggttgccagatgtcacaaaccaattgattgaaagcgccaagacaatcccaataatcaaaatcagcagagcaaaccaccagccgctgtattgtttgcgacgttgtcgacgtcgattttcttcagaattgaagtcatactttttatattgtggttcatcgtcatgcctattcaaattaatacctcatttagattctcttattgcatgttgatctagttgaatatattataacagatagcgaaaaacttgtatttttaaaccttaaaggatggcaaatatggacagaaatgaagttaaaacatttcctgaattgaccactcaagaattatttcagatctacaaattaagagtggcggtttttgtggttgaacaaaaatgctactaccaagaagtcgatgatgacgatttgaccgcttatcatttgatgtttaaggacgaccaaaacaacatcaccgcctatgcgcggattattcctgaggaaaacgccacggttgcccggattggcagggtcgtggttgaccccaatcatcgcggcgacggtctgggacgcgagttggtgcaaactgctcttgatcgaattccgacattgatgcccaagactggaaaaattgtcttagctggacaggagtacctcaacggattttacaaatcgtttggttttaagaacgttagtgatgtctatctggaagacggcatcccccatattgatatggaaatgcagttgcaagattagattgacaagcaaccacggtatattataattatcacaacgaatgaatctttaactctggtcccgtgaggctggtaagaggacgatattgaacgagcaattgctcgacttggtgtctgccttgcctaacgcggggtggacacctttttgttgcatgactttccaagtgagagcctgtcacaattcatcaaggggtcaccctgaagcggagttgaaagattcaaatacttttgagggtggcaaatatttatggcagacaagaatgaatttcatgatgatcgtgcgattctcgacatccatgacatgcccaaatttttcccgtgggttggattatcattgcagcacatgttttccatgtttgggtcaacggtcattgttccactgttggttggattgagcccaagcatcgcgttgttcgcatccggtgtcgggacactgttacacatcatgattacccaacgcaaaattcctgcatacatgggatcaagttttgcgtttatcacgccaatgctggcgctcatgaagaccactgggtatcccggaatcgctcaaggggtcattggtgtcggaattgtgtatatgatcgtggcagccattatctgggcggttggctcggactgggttgaccatattttaccgccgattgtggtggggccgatcgtgatggtgattggactgtcactggctggtagcgccgctcaagacgcgatgatgaaaaatggcaagtacagcctgttgtactttgtgattgccttggcaactttattcttagctattatttttaacatgttattcaaaggcttcatcggcctgattccagttttgttagcaattgtttgtggttatctcatctcagtcttctgtggcatcgttgatttaaatgcgattgccagtgccccgtggtttaaaattccggcctttgatattcctggaattgattacaaatttcacattgattgggctgccatcttagcgattacgccaattgccttcgtgacgatgaccgagcatatgggccacattatggtcttggatgaattgaccggccgggacttcttcaaggatcccggcttgaaccggacgttggccggagatggtgctgcttcgctgtttgctggattagttggtgcacctgccatgaccagttatggtgaaaacatcggtgttatggcgattaccaagatccacagtgtttatgtgctgatgggtgccgccatgtttgcgattctgtttgccttcgtgaacaaattgaatgttttgattatgcagatgccgatgccggtcatcggaggaattagcttcctgttgtttggaacgatcgcaactgccgggattcaagtgatggttgaaaataaagttgatatgggcctgaagcgcaacttgatgattgcgtccacggtcatggttatcggtgttggtaatgcttatctccaactcggtaagttccagtttaccggcttggcatttgccacgattatcggaattgttctcaatttggttttgccgcaaaaagctgccagtgaacgggaacatgaacagcagttggccgataaagctgccgaagaagaaaagcagcgcttgcttcaccagcgccatttgcataaataactcaaattttgtacactactcctaattgtcaggagggatggttacatggaacaagctcaaccagcacaactgaagtataagcatgccagtacggcggcagactttaacgccgccaagcagatttttcttgagtattccaagtcactcggattcgacctgggattccaagacttcaatgatgaattaaatgaattagcgacccggtataaccagcccaaaggagatctcatcttagcatatgtgaatgatcaattagctggtgtggtcgctgttcatgaatttgaaccggggattgctgaaatgaagcggctttacgttcgtgacgacttccgaaaactcgggattggtcaggaactggtcgccagaattttagccagtgccgagcgtttgggctatcaggcgattcgtttggacaccttgaaatcaatgaccggggctttaaaaatttatcacgccgccggttttaaaccaatcgacccgtaccgctttaaccccttggatggcgcggagtatttagagttggattttaaataattgaatatgggatcatgatgttgattccagaaccaagaaagaagaggctgagatctaacaatttgttagtaatctcagccttttttgagtgtcactgttatttggatcaaacgtgtgaaagaggacagcaagcgaggtttaagcgccaccagccgaaaacctgactcggtttcctggtgttttactgttatttggatcaaacgtgtgaaagcggacagcaagcaaaatttaagcaccaccagccgaaaacctgattcggtttcctgtgttttactgttatttggatcaaacgtgtgaaagcggacagcaagggaaatttaagcaccaccactcgaaaacctgactcggtttccgcctggcggtgcttaaatttcccttgctaaacgtccgctttcacactctcttttattatccttgtaaataaatactattccttcgaacaaccggctgcttgagcagtgccagcagcattgggataaccaacgcaatcatcactttgacggccacgttttcaataccagcctgttctgcgatgtccagcagggtgccgtgtaaatacataataatcatggtgtgcttaccaatggttgacagcaacaagccaatcgacagcttgctggtaagtgccgatagccccatcacaccaaatgaaaaaatcagtgggatggtggccagcatcaagattttcggctctgatgattgaatcagatgagatttcatcgaaaattcaaagctgaatttctgattaagatacaagccaatgattgccaaggaagcaccaaccagtaatccaatcggcaatggcttttcaatccagtgccaatttgtgtggaaaaacagataaccgacgtaggtaaagaatgcagcaatcaagacgatatccaagttccagggcattgtttgataattgtacaagttcacccaatcaattttgtcatagcaggtagagataaataatcccaacccgacaattgtgagctgaccaattctggatttaacggtcgaaatcaacagggtcaccgccgtaattgacagcaggtagacgttcacaaaccagaacgttgacgtgtacaggttcaatgtccggcccccgaccaacagtcttgagaggtggttaatcaagtaatcccaatttttgtcatacaagatgctatacaacaggatcaagccgatccccgcgataaagtagatcagcagatcccggtaaatgcgtttattaaagaactttttccaatgagttaatttagttgtgtcaatcggcttcaagaagaatccgccgacaatgaagaacaggggcatgtgccaccaataaataatgttggtggttgtgccgctggctaacgcgtggccaaacaccaccgcaataataccgtatgctttggcgatatcaatccattcaattctctttttcaacatagctgttttgcagtcaccgtccttagtaaaaataatctagtttacttatacattattgaccttaaaacagacttaaatcaaaactggggtctggcattttgcaccaattaaataagagcaaaggcaaatgcctgagctcttttgagtgggatgattagtcaacactggtaatgaaatgttgaaagattcgatttttagtaattttgccgacgactttggttggctggtccttatccaccactggcagagaatcgactttgcgatccaataagagctgcccggtttggaggaccgacatatctggggtaacggtgaaaatattgggcattcgcgtcatgactgtactggcaagtgtcagtgaagcattggtattattcagggttgcccgtaacaaatccttgcgggaaattaagccgaccagttcttgacgatcgccaatgacgtaaagggaaccgacatcctcgataaacagggtgttgaccgcctcggtcaatgtggcatcctcacgaatctcagttggtttctgcagaatattagcgatcggttccgcataaagcttgtgatagcttaaaggcttggcttgagaatcattgtaggtgtaaccaactttgggcttggcttccagaatgttgaatgccgtcaggagtctgaggtcggatcgaatggtcggcatactcaaccccaactctgcagcaatttggcggctggtgatggggtctttctgtttaacaatgtcgacgatttggttttgccggtcggatagtttcaagttaatcgctcccactttcgatagtcgttggtccgtaccactagtccaattctatcatatctgatcaaatatgtatccaataaaacgtcttatttaagaaaacggattggtagtaaaattctttttcaacgtgccaacccttttaagagcaacatttcattaccgttaaataaaacgttctttaaaatttaatttgcattattaaaacgtatcatatatgataaatgcatccaatgtaacacgctaattagttcagaaaggacgttatgatatgaaatacatttatcgctttgaagaaggtaacaaggatatgcgtcgtttacttgggggcaaaggggctaatttggcacaaatgacctcactggggttcccggttccaagtggatttacaattagtaccgaggcctgccaggcattctatgacaacggtaatcagttgaatgacgacacgctcgaacaaattgatcaggcactcgaccaattaagcactaaagtggggaaacgattcaacagcccggataatccgttgctggtttccgttcgttccggagcggcaatttcaatgcccgggatgatggacaccatcttgaacattggtctaaatgaccagactgttaaaactttagcggcgattaccgataatgaacggtttgcctacgatagttaccgccgtctcttagcgatgtttggcaacgtggtgtacgaaatccccgaggacatttttgaccagattctcgaagatattaaaatcaccaatcattatgactccgacctggacttgacggtggcagatttgcacacaattgtcggtaagtttaaagaactctacatagccgaagccggcaaagagttcccgcaggatcccaaagttcaactgcttgctgcagtgaatgcggtttttgaatcatggaacaatcatcgcgcccaggtctatcgccgggaaaaccatattgccagtgatttgggaaccgccgttaacgttcaaatgatggtctttggcaatgctggcgaagactcggggactggggttgcgtttacccgtaatccagcaaccggggagaacaaattattcggggagtacctcttaaacgcccaaggggaagatgttgtggcggggattcgaacaccccagccgatcagtacattagccgacacaatgcccgatctttacaacgagtttgtggccactgccaagaaactggaaattcattaccgcgacatgcaggatttggaatttaccattgaacacggaacactgtacatgctgcaagccagaaacggcaaacgtacgccgaccgcggcagttaaaattgcggttgatttagtcgaagaaggcttgatctctcggacggaagcgttgctgagaattaatccggattcaattggcgcgattctctacccagaattcgacgaggaagccctgcagcagagccagccggctgccagtggtctgccggcttcaccaggagctgcttccggccagatctatttcaccgctgagtctgccaaagctgcccatgatgatttggaacagcaggttatcctggttcggcaggatacgtcaccagaggacattgaagggatggtcattagtgaagcgattgtcacttcccgtggtgggatgacttcccacgcggcggttgtggcgcgtggcatgggaaccccggcgacggttggggtgaatgatctgcaggttgactatcaaaacggggtcgccaccattgccggaactgagctgcacgaaggagactggctgtcagttgacggcactaacggtaacctttatttcgggcagattcagaccaatgattcaagggtcaatgacgacctgtcgacaattttggattggtccaagcaggaaggagacctgggcgtgtatgccaacgccgacacgcctgccgattttgcccaagcactgaaattcggtgctgacggaattggcctgactcgaacggagcacatgttcttcaaaccggagcgactgctggaaatgagacggttgatcatcgctgaagacgccgaagaacgaaaagcccccctggccgagttactgcagatgcagcagggagacttttacgaattgttccgtttatcggaaggccgttcggtcacgattcgtttgctggatccaccattacacgaatttttaccgcacgacgccaaagaaattgctcaagtttccgatcagttgggaattgacccggaatacctggttcgtcgagtggatgccctcaaagaaatcaacccgatgctcggtcatcgtggcgatcgattggctgtaaccttcccagacatttatgagatgcaggtacgggcaatcattggagctgctttggagctgcacacccaaggactggaaattcagccacacattatgattccactcaccggttccaaggctgagatgagctgggttcgagacatcgttgtgaaccaggtcgaaagcttgtttaacgagcaaggaaccaggttgaaatacacggttggaacgatgatggaaattccgcgggcctgcttaactgctgataaagttgccgaagtatccgacttcttcagctttggcaccaacgatttaacccagctgacctatggcttctcccgggatgatgtgggttcgttcatgccagaatacattgagaaggggcttctcaaagcagatccgttccaaacggttgatgtagacggcgtcggtgaattaatgaagatggctgttgagaaaggccggtttaccaaacccaacctgccaatcggcgtttgcggagaagttggtggggatcccaaatcaatcgagttcttcgagtcgatcaatgtttcctatgtttcctgctcaccttaccgggtaccggtggctcgcttagcagctgctcaggcgaaaattaagatgagtaagaaacaggatgtgattgctaattttgtgaagagttagaatgtgaaaagttagagtattatatgtatgcaaaaaggctgccaaatcggcagcctttctgtgatgaaacaacttaatctcttggcgcgaatcccattggtccatgaccgcgaggatcgccgtggggaccaccaaagccgtgatggccatgagggccgccgccaaatccgcggtgagggaaacggtgtccccaacctggttcgtcgtcgtggtcagggagtttctctttgagtgacgtgttcaatttactcaacagttcgtttaattgagccaattcttcatcagagagccccgcaaaaatttggtcgagcatgtcatcagtggaatcatcgtcttcgatggctttcttgccttcgtcggtgatggccacattggtaactcgtttgtcgttttcgtcaggagtccgggtgatcaagccgcgctcttccaacttggacaacaattcagtcattgatgatggtcggatgtccatgatttcagccaactgactttgaatcagtgtgccttccttggacaggataaccaggactctgttttggccccgcaaatggtaaggccgttcttggtgacgggcaaatcgttgggttccatgaaggaagccgaagaacttgcctaatagttctcttttattaatatctgccatattcattctcctttaaattgttatacttaggtacctaacaataagaagtatacactgaatttttttgaacacaagcaaagtgtttcggtacctaactattataacgaattacaaattagctttaaatctgattggttatcaactgaatattagtaagtcaaaaatgtaatttcttgaattttagcctcaacgtttttacactgaaagatagtacaaattgagtatctaaagggggagtatgaatactgaactgttttaatgtatttttgtttcaaatgaaagggattacaagatttgattgattcagaaatgatcccctaaggagggataatcgtgaaagcacgtcatttaagtacgttctttattttcttctttggtgcattaggtggccttctatttggatttgatactggtattatttcaggtgcctcaccattgattgaaagcaattttaatttaggaactgaacagactgggttcattgtctcgtctgttttgattggttcatctgttggtgcgttgtcgattggttcactttcggaccggtttggtcgaaagcgcctgttggttttagcctcgatcctattcttaattggatcaggactgtcaatgtttgcccaaggatttgtatcaatggtcattgcccgaatcatcttaggctttgctgtcggatctgcgtcagctttaacgccagcctatttggcagagttggctgatgcaccgcaccgtggctcacttggtacgatgtttcagttgatgattactttaggaatcctgttagcatacgtttccaacttaggattcttacatcacaatctgctgggattacgtgactggcgttggatgcttggatccgctttgattccagctttgatgctgtttgtcggttcaatcattctccccgaatcaccacgttatttggttgaaaagggtcggattgacgaggctcgggacgttcttcatgaactccgggcaaagacagatgaggatcctgacaaggaattggctgggattcaagaagttgccaaccaacccaagggcggtctcaaagagctgtttacctttgctcgcccagcagtgattgttgcgattttgctgatgctgcttcaacagttagttggaattaattcagtgatttatttcctgccgcaagtcttcattaaaggctttggtttccctgagagtaacgctatttggatttctgttgggattgggattgtcaacttcctctgcacgatcttggcatacaatatcatggatcgattcaaccgaagaaccattctgctatttggttcaatcgtcatggcattgtcaattggaattctctcaatcttgaacttcactttaaaagttcaagacgctgctgttccaaccatgatcctgattggaatttatatctttggtttcgccgtttcatggggcccaatttgctggttgatgatcggtgaaatcttcccattgaatgtccgtggagtcggaacttcaattggttccgctgccaactggattggaaactttatcgtttcacaattcttcttggaattacttcacatgtttaacaacaatgttggtggaccatttgccgtctttaccttctttgcgatcgtttcaatcttcttcgtcatctacatggtgccagaaacccgtggcaagacgcttgaacaaattgaaatggatatgcgaaagaatgccgcattgaagtcggctgctcaaaacaaatagactcgcttagattaatagagacacaaaaatgctcgagaacgattggttcccgagcattttttatatttcatgaacgtcacggttagtctgtgcagagacgtttaattgcttcagcgtaaatatccattgccttgtacatactcttaagctcccaattttcattgacctgatgcataaaatcaggggttcctggcagcatggcaccataagccacgcagttgttcatggttcgggcaaatgtggcaccgccggaaatttgcggttgggtgtcatcgccggtcaaatccttgtaggttgacattaacgtcttgactaaatcactgtcagttggcacatacagtggggcaacatagtcaaatgcctcgtagtgcaggtcatatggttcggccgcctccttgagcttttcaatcaattcgtcatgattaacggtgacgggaatccgcatgtcgacttgcatgcgagtttctttttgatcaattttgagactggaaatattcatggtcaaatgaccagacgcctcatcttcgacatcgccaagcagattggtaccggtagcgtcctcctggaatttcttgccaaagaagtcgagtacggggctgtcaaagacgttgtccaaggcaattgccaaacgcaagactgcattggtaccttgaggggcattcatggcatgaaccgctttaccaacgacggtgatgccatcagtgccatggtcttcgtatttgaagccgtgtttgtccagggatgccttgacttcatccagctttggcccgttgtaaggggctttggcagggacggcgttaaaagcattttccaaatcgagggacagatcatccatcccgggaccaaccaggtaggactgttccagccctttttctgcgtaaatcagtgggaattcggcatcgggtgcgattccaaaatcagttggggattccttttggttatacacagcaatcccacgccaaagggtctcttcgtcggtgccgaagataaatcgaatgcggcagttgaacttgtacccacgatcaactagggctttgacggcgaacatggctgccatcgaaggacctttgtcgtcttgggtgccacggccgtaaatgtagccatctttgatggttgcggtaaatggatcggaatcccaatcatttggatcaccggccgggacaacgtccatgtggccaataatgccaaagatcttatcgccggagccaatttcagcatagccataatggccttcaggatctttaaacgtcttgaagccattttcttcagcgatctgtaagacttcggttaatgcgtcgtcgattccttgaccaaatggcgtcgttttggaaacggtggctggatcattgactgaaggtttgctgactaggcgttttaagccttcaacagcttcgttttgttctgtttctgtgactaatttttcagacatttttgttggtgcctcctaggttgagttttttggtttttggttgttgttagtggttttggttggtggcttttgtttgaggttgatgggtgtttgtgggttctttttaccgagtggaaaggcgctccgacggccctgacccctactgtgtaagccgaaaactttaatgatggaccaaaaacgtccatcatcaaagctttcggcttacactccggggtcacccgggcctcgtcgcgctctgattgaaatgcgctccgacggcccagatgctaacttctaagggtactgtgattaaagccccaaaaccaggggctttaatcacagtacccttagaaaccgcatcacccgggcctcgtcgcgctctacagcagtgccattacccccaggaaaatcgcagtcgctaagaacaagtaaaccatcaatttgaacatgaatttccaccaagtcgtgatgttgacgtgggcaattgtcaaggctcccatcacaacgcccgatgttggtgtgattaggttaacccagccggatgcactctggtaagctgttacaaccaagcttgggtcaacaccggcgaacttacccattgggccgatgatgcccatcgtagcggctgccaggcctgacgttgatggaatcaagaaggacattgggatgtagaagatgtatgccaagatgatgaagacaaccgacccgaggttggacaagcccatttcaccccagtggagaacggttgcggtgatgtttccatcattcatgacaacttgaattccacgggcaacagcaacaacaattgctacacccatgaagtcactcattccggctaagaatgattcgataaatgtggattccttcatatggaagacgaacatcaccacgattgccatcaagaagaagagggtcgtaatttcagtgaagtaccaggaaccaaatggtaccaggttggaaccaaccagactacctaagaatggcacatcttgaacccatttggtgaaactggtaaagaaggtccagttcttgttgatttggtcccatggaatcaagcccatgatcatgactaggaatgtcaaaccaaacatccagagaacggctttttgtcggccggtcatcttagtgccgggttggtcttcatggttcaacgcaaatcgtttcaaatcttcttcacgctgttcaaagacgtaagaccttgaaggatcattttcaattttggcagcgtatcggtaaacaaacaggatactgattgccaccacgatgacaaacaggaccgcccgggaaataatcccatctccgggtgaaatgtgcagcgtttgtgaggcaaccccggtcgcaaatgggttaaccgtggatgccaaacatccgacctgcgaaccaaccaagacaattgcgacggccactagtgaatcgaagccgaccccaatcatgactggaattagcagtgggtaaaaggcaatggtttcttcggccatgccgtaagttgacccaccaagtgcaaacaaaatcatcagcaggggaatcaaaactttttccttgcctttgtattttgacacaacagtcgcaattccatcatcaagcgccttagtttgattgacgactcccaagaagcccccaatcaccaggatgaacagtgaaacggagatcgcgccttccgtcgtatcatttccgaccattccataaatcggggcggagaagacgtcccagattccctgcggattagaagccaccgctttgtaagtgtgggcaatgatattgccggctttgtcggtgctatactgtccggcagggatgatccaagttaaaatagcaacaaaaataatgatcagaaataagatggtgtaggctgaaggcatcttaaatcgacgtttctttggagttgattgttgattttgcataatgttcacttccttttcctttactgactatagtttacaaaaaatctataaagattctgtgaagaaaaatcgaattatttacataagttaaaattatatagaaaattcacaatcacaaatgattatagacactttgtacgccctcattataaataggaagatatagaatatacaaagaaagcgctttaaaatttctcataaaccgaatggtaggtctcattttactcagattttaaaggatttgaaccttctctcaaaaatggaagcaagaaaaaaggccggtacatgcggattcgcatgcaccgaccaaattgacattttaattataaaagcaatcgtgcgttactcttcaatatcattaaagaaactcagcaactcttccttggtgagattatccttctcgtcaccggcgatatcgtaagtgattcgaccgttatccaagacaattaagcgatttccgtatttcagggcatcatccaaatggtgggtgatcatcaaacaggttaaatggttgcgggtaatttgatcgttcgtggcagtcatcaattcttgcgaagtttgcggatcaagggctgcggtgtgctcatccaataacaggatgtcggggcgcttgatggtggccatcaagaaactcaaggcctgtcgctggccaccggaaagcttgccagttgccgtgttcagccgatgttccaaaccgttattcatcactgaggtgatttgcttgaatttatccatgtgcgtcttgagatgccgcggtgcaaagccgcgacgttggccacgcttttcggacagcagcagattttctgccaccgtcatccgtggcgcagttcccattttgggatcctggaatactcggcttaagaaccgggtccgcttctcaaccgacatgctggtgatgtccttgccgttcaggagaatttggccgctggtcacagggagattgccgccaatgacgttgaacaaggtcgatttaccggccccgttagaaccgagaatcgtaatgaagtcgccagggaagacagataaattcacgtgatccatgatgttaatctgctcaggtgtgccgtggttgacggtgaccacaatgtcatttaattcgaagattggttcagtcatgtttggtcatcccctttgctaaagtatggcggattcggaagcgtttttccaaaaccgggaacatcatgaataatgccaagacgatagctgaaattaggttcaaatcgttggcgttgaagccgagcttgagaaccagcaaaataacaaatcggtacaagatactcccgatggtcactgcgatcagccgctggttcatcgtcaaatcgccaaagacgacttcaccaataatgatggaagccagggcaaccacgatgacaccgattcccatattgacgtcggcaaaaccattattttgagcaaccaaggcgccaccaaggccaattaaaccgttagaaacacccaagcccataatctgcatggcatctgtgctgatgccaagtgagcgggccatgttgggattatcaccggtggcaataaatgcttggccgaggttggtctggagaaagtaaacaataagtgctgtgacgatggcaaccacgacgatcccaagaaggacactgtcaaaatagggtggtaaggattccaaaaagtggttctttaacatggtgggtttgtcgaagagcgataaattggctctgcccatgattctcaggttgactgagtaagcagcggtcatcaccagaattccggcaagtaataccggaattttacctttggtatacagcaaaccagtcaccaaaccagccagcatgcctgccacaaaggcaatcaaagttgcgactagtggtgaggcccctgaataaatggcggcgacacaggcagctgcgcccatggggaaggttccttcaacggtcatgtcggggaaatccagaattctaaaagtcaggaataagccgataccgacaattccccaggtcaatccttggccgatggctgagacgataatactcatttgatcaattctcctttttgttgggcttcttttaagaggttggcaggaatcttgattcccaacttgttagcctgcttttcattgataattaattttccgtgacggaagaatttaattggggtggttgacggcttcttcttacccttcaatatttgggcactcatcttaccggtcgcaactcctaattgatactggtcgatgccgtaagttgttacgccgccttgcttgaccatcgtatcaacagctgggaaaacagggactttggcgttattggcagcgccaaccagtgtctgcatggccccagcaatcgtgttgtcggttgggacataaatggcatccactgagcgaaccgcttgttcagcaacctgggtcaaatcgttggtgttggcgattgagtatgctttgagacggacgttttcctgtttgcataatttgacaaacatcttgtattgggcaacagcggagtcatcactggaagtgtagataattcccaaggttttcatttttggcatgaattgcttgatcaaattcagctgctcttttaaaggtgcctgatcggaaacaccggtgatgttgccgccgggtttttcattgttctttaccaaaccagcgcctttaggatcagtgatggcccccaagatgacgggcttgtgggtaatggtgttggccaatgcctgagcagatggggtggcgatcccaattgaaagatcggcgtcctcgttggcaaacttggtgctcatggtcttcaaattactttgatcattttgggcattttgaaagtcaattttgatgttcttaccaggtttatagccctcttcttcaagaccgtggataattcctttatggatggcatccaaagctggatgggacatcaactggagaatccccacggttggcttggcctggggcttttgcttctgttgtccttggaaaaatgcaacccccaagattacgacaaaaattaacacgacacctgaaattaaatattttttcttcataatagctgtctccctcaatttgaataaatatgtaacgccatcagttatgcgaacaaaaaacgagcattccggtctgaccgaaatactcgtgataagtcggcctgccgaaatcatctggccagaccgttcgttttccgaaagattgccggcacagatgcgttcatgatcgcatgcttaagatcaagtcgcatctgtgtcgatgtgacttgttaccggctttgccaactgcgattaacaagtgaactcatagcaatcttcctttcgtgatagaatacctataattttaaatgattgtctacctttcgtcaacacaccaatctgaatccatcatgaaaatgaatacattatttaacacagtggtaacttaatcatgatattctgttattgaaagagggggttcattcatgaaaaaactcgttaagcttgtcggtgtgatgctggcctttgtcgtatttgctgtggtggccagcccacagcccgcacaggcagcccacaataattatcgggtgaaaacgctgaagacttatcaaaattacagcaactatactgaagatgttgcctttcacgcgaaggccaaaaccaaggcgtccgtgtggaataaccaggaatttgacaaaaatatcaagtcgaatgtcttctacaaaaagggttacaaactcgccaatcacaaaacaaccacgtggtttgtcgagaaaaaggttcgcatctatcacaaattgaagagtgcgacttactattacgttgccaaccggactggcaacatgcaggggtatgttcgaacaaatgctttgactcccggatttagcccatatgggtatcaaattatcagcacaaagtggtataacaagtacgattatttccacgtaaaggattcgtacaaagcaaaaaatgtttacgtatggaattatacccatactaagaaacgggcgaacctgaaggattatcctggtgctgtgttccagaaaacccatacagttgtcatgcagcacaatgggaaagataccaagtacgtctacctgtccgggactttaaacggtaccaccaagagtaccagggggtacgttgcagaatctgcgatcacgggtgggcttaatcccgatcataccggaatgaattatgttgatattggttattttgtgaataataccgattttaaccagtatcttcaaaccggtaagaatcaaaaactcgccagagaaattattaagttattccctaactctcagccggatttggggttatcaaagatcgctgcctataattatgacagctttgataatgatattgatggtgatccgagtccgatcagtacaaccggctacaccgatatcaagacgttcccggcaattcaaaagtggctttacaccaaccacaatgcgtccaacgcaaccaaaattgccggtgttaagaaattgctgaatgcggaaggctacaccgacagtaagcgggcgtccttatctggatacaaactcggcattcaaattgtcaataacattgtcatgccaagtggtgaatctggtgatttggcaagtcgatatggctatgtgtttatcctcggtaaagttgataattaaatcatggtcgactaaaggcattaacctcagtgacgttttgtgacgtgggttaatgccttttttgatggtgcattcacttcaacaggtcaaatttgtccatgctctgaagcgtatccagaattgttttctcaatactgccgactggctgccaccccagcaggtcgcgggctttttgattactgacattccgattcacgtccagtaacagttgaccttcttttgcctgttggttgaatagggaaccgaccctcaccacccagtttggtaaaattttatcggcaacttcgcttttcagttgggggtaatgctgtcggataattgttgccatttccggcatggtaatctggccgtcggcggtggcgataaaacgttccccggcggcatttggattttccatggcgcgaatgtgcaaatcggcaacgtctctgacgtcaacaatgttgagcggaatgttgggaatgtgtttcatgctgccattcatcaagttttccaaaataccgaaactccctgatatatgcccgttcattgccggtccgagaatggcaactggattgatagttgtcaacgccattgaattgtcagactcattcaccagcttccaagcttctttttcagcgagtaattttgatttctcatatagggaaaggcccttttgatccggattggtccagtcattttcatcggtgatactatttttgtccagattgctgaaaccaacgccgccaaaattcgcggtcatgacaagtcgctttactcccgcattctgtgcagcttggacgtttcgggtgatgccgtcgattgctggtcgcattgccgcatttttatctttggtgttaccgaagaatacgggggatgcgacactcatgacatctgtgatgccgttcattgcttcctgccagccatcgtcttttgataaatcagctcgaacaaagtccagctggtcgagatttgcaatgttgttggcggctaacgtatccaataccagtgattgcttgtcgagagaacgcagcgtggttctgacgtcataacctttagccaacaattgcgaaataattcggaggcccagaaagccgttcccgccagttactaatacttttttaatcatttatattctcctcgttaatttaatatctttatcctaaaggctagagtatactctagtgcaagacattaaacttaaaagggatgatgagatgacttattcaattaaagaggtcgccgaaaagaccggcctttccatttacacgctgcggtattacgacaagcaggggctcttgccgtttgtttcccgaaacgaggccggatatcgtgagtttaccgattctgacttgaattttattcacaccatttgctgtttgaagaacactgatatgaagattaaggacattaagaaatacattggttactgtatgcagggagccgcttcgattgatgaccgcaaacagctgttgttaaagcatcgccaagaggttttggcaaaacagcggctgttggcagacaatctgaaagaaattgattacaagctgaacgtgtatactgatccaaattctcaggcaattattgatcgggaagttgcctatgtgcaagatgagaaggctaagaatcatttggcggatccctttgctgtgaaatagccacagccttgtgagtgcattcttttttgtggtggaaataacgccgtggattttagaagaaaatgcatcttcagtggttactaaacgccagtggttggccgtttctccctcaacctcggacaaagtgtatattgattaacattcattaaagtgcattgtctcgtttctattggggttgtatgctatagatacttattttcctataacaaaattgcttggtaaaagcacgtaaaatagcaggaggacagtcgtaaatgaacgctgataagcttaagcgagttaagaaaagatataaacagtcagggcatcataaactccaaactagaattttcaaaacaaatgacccccgccttcgcctctttgattttgactatggggtagttatgggcctcacttcgaatacggaaggcatgtcagatgttgaaatgagtgatgcgatcggctacaattcttctcaactcggttatgatgtttatcgaatgcccgatggtcaattcttaatcgatggtgttgaaaaggaccaagtattttcccaacatgatggctgcccagttttgttactggttccaccaacgttgcctgaaaaaagccgaattgctctggagaacaaaatatttgagcacagaaacgaagggccacatccattttattagaggcaggttgtaatgaagaaatggatggataaaatgaattccttttgagcggaccagctcacctgctggtccgctcaaaaggagtttttttgtgagcttaaggaggatcgatggttctaaaaatgcggcattctacattgaagatctttataagaccttaactggatgcaagatcaataaatggatcgaaaaattcccaaccaatctatgccaaaagggtttcggataattgccggttaatgcataatagatgatgtgccaaggcgatttacagggcaacaatattccaaggagtttacgagcatgaaagttaataattatcatataggtctcgatattgggacctcatcaattggttgggttgcaatcggcgaagatggaaaaccattgcggatcaaaggtaagactgcaatcggtgcccggttgtttcaggaaggcaaccccgctgctgaccgcaggatgtttcgaaccactcgacggcgtctgagtcgacggaagtggcgattgaagttattagaagaaatatttgacccatatattacacctgtcgattccacgtttttcgccaggttgaagcaatccaatttgtcgccaaaagattcacgcaaagagttcaagggttccatgcttttcccggatttaaccgacatgcagtaccacaaggattatccgaccatttatcatttacgtcatgcattaatgacgcaagatgaaaaatttgatattcggatggtttacttggccattcaccacattgtgaaatatcgtggcaacttcttaaactcaacaccagtagattcctttaaggcgtccaaagttaattttgttgaccaatttaaaaagttaaatgagttgtataccgcaattaatcctgaagagtcgtttcaaattaatctcgcaaatagcgaagatattggccatcagttcctcgatccctcaattcgtaaatttgacaagaaaaagcaaattccaaagattgttcctgtctctgtggatgataaagctacagataagattaatggaaaaattgcgtcagaaattattaatgccattttaggttacaaatcaaaactcgacgttgtcgtacagtgtacgccagtagattccaagtcatgggcactcaaattcgatgaggaagatattgatgctaaactgcaaaagattttacctgaaatggacgaaaaccaacaatcaattattgctatcctacagaacttatattctcaagtaactttgaatcaaattgttcctaatggcatgtcattatcagaatcaatgatcgaaaagtacaatgatcatcatgaccacttgaagttgtataaaaagataattgatcaactcgctgatccgaagaagaaagccgccttaaagaaggcatatagtcaatacgtgggtgacgatggtaaagtcatcgaacaagctgacttctggtcgagcgtcaagaaaaatttggatgattcagatctttcaaagcaaattatggatctgattgatgcagaaaaatttatgccaaagcaacgaacatcacaaaatggtgtgattcctcatcaactgcatcaaagagaacttgatgaaatcattgaacatcaaagcaaatattacccatggcttgccgagatcaatccaaacaagcatgatcttcaccttgcaaaatacaagattgaagaattggttgcctttagggtcccatattatgttgggccaatgataacgccggacgaccaggccaaatcagcagagactgttttttcttggatggagcgtaagggtaaggaagctgggcagattaccccttggaattttgatgaaaaggttgaccggaacgcatccgcgaacagattcatcaaacgaatgaccaccaaagatacttacttaatcggtgaagatgttcttccggacgaaagtttactttacgagaagtttaaagtcctcaatgagttgaacatggtccgggttaacggcaaattattgaaagttgctgataaacaggccatattccaggatctcttcgaaaactacaagcatatctcagtcaagaagctgcaaaactacattaagtctaagactggattacccagtgatccggagatttcaggtttatcagacccagagtatttcaacaattctttggggacctacaatgatttcaagaaattatttggtaataaggttgacgaaccagatcttcaagatgatttcgagaagattgttgaatggtcaactgtatttgaggacaaaagaatcctccgggaaaagcttaacgaaattacgtggttatctgatcagcaaaaagatgttttagaatccagtcgttaccaaggttggggccggctttccaagaaactgttaactggaattgtcaatgaccaaggcgaacgaatcattgacgaactttggaataccaataaaaatttcatgcaaattcagtctgacaatgattttgccaaacggattcacgaagcgaatgctgaccaaatgaaggcagtcgacgtggaagatgtgttggcagatgcatacacttctccacaaaataagaaggccatccgccaagtggttaaagtcgttgatgatatccaaaaggccatgggcggagttgcgcctaagtatatttccatcgagtttacccgttcagaggaccgtaatccacgtcggacaatttcacgacaacggcaacttgaaaataccttaaaagatactgctaaatctttggctaaatcaatcaatcccgagttactttctgaactggacaatgcagcaaagtctaagaagggcctgactgatcggttgtacttgtacttcacgcaacttgggaaggatatctacacaggaaagccaatcaacatcgatgaaattagtacttatgatattgatcatattttgccacaggcgttcgtcaaagatgattcactcaacaaccgtgtattggtatcgaaggcgattaacaatggcaaatctgataatgtacctgttcaattgtttggtgccaagatggggcacttctggaaacagcttgctgaagcaggcttgattagtaagcgcaaactcaagaaccttcaaacagatcccgataccattagtaagtatgcgatgcatggattcattcgtcgacagttggttgaaaccagccaagttatcaaactggtcgcgaacattttgggagacaagtatcgcaatgatgataccaagattattgaaattactgcccggatgaaccatcagatgagagatgagtttgggtttatcaagaatcgtgagatcaatgactatcatcatgcgtttgacgcctacttaacagcctttttaggtagatatttgtaccatcgatacatcaagctacgtccatacttcgtctatggtgatttcaagaagtttaaagaagataaagtcaccatgcggaattttaatttcctccatgatctgactgatgacactcaagaaaagatcgctgatgccgagactggtgaagtaatatgggaccgcgaaaattcaattcagcagttaaaggatgtttaccattataaattcatgctgatttcacacgaagtttatacgcttcgcggtgcaatgttcaatcaaaccgtttatcccgcatcagatgctggcaaacgaaaattgattccgataaaagctgatcgaccgattaatgtctatggtggatatagcggcagtgcggatgcgtatatggcaattgtcagaattcataataagaagggcgataaatatagggttgtcggtgtgccaatgcgggcacgggatcgtttagacgccgcgaaaaaagtcagtgatgcggactatgaccgggctctcaaagatgtattgacaccacaactcacgaagactaagaagagtcggaaaacgggagagatcacccaagtcgttgaagactttgagattgttttaggaaaagtaatgtaccgacaattgatgattgatggtgataagaagttcatgcttggaagctcgacctatcaatataacgccaagcagttggtactctccgatcaatctgtcaagacacttgcaagcaaaggaagattagatcccctgcaagaaagtatggattacaataacgtctacactgagattttagacaaggttaatcagtacttttctttatatgatatgaataaatttcgtcacaagttgaatcttggtttcagcaaattcatctcatttcctaatcataatgtctttgatgggaatactaaggcgtcttctggaaaacgggagatcttggaagaagtattgaatggattacatgcaaatccaacatttggaaatttaaaggatatcggcatcaccacgccgtttggtcaattacaacagcctaatggaattctgctgtcagatgaggcaaagattcgttatcagtcaccaacaggtttattcgaaagaaccgtcagtctgaaggacttgtaacaaaaaaggaaccattctccaactgaagaatggttcctttcgcttatgtaatgcccatataatgggtcaaaagttgaaactccgcgcaaagcgctttgcttgattttaacacaggatgttaaatcaataaggtcaaacatgttgggagctacccaacaaaaataatgataccccaattcagtaattgaggcaagggagattttattatgggatggcgatcagttgtcatatcgcagcacgcaaagatgtcatattcatcacgaaatatgattgtccaaacgatggacggcatcaatcaagtgccaattgaagatattgatttattgttggtatcaactactcaggcagtcattaccactgctttgattagtgagctggtgaaaagtcaggtcaaaatcatttttaccgataatgccaatgagccggtttgtgaaacggttgggtattatccaaatagtcgggacgttgatttaatcaagaaacagttttgttgggatgagaaacgccagcagtttctttggacgaggattgttgcaagcaaaatcgtcaatcaggttaatgttttatcgatttatggcgttgaaaacagtgatttgattgcggaacttgataaattggaaattgatgacgtcaccaatcgggaggcggtagttgcacggaaatatttcccgctgttgtttgataataagtttagccggcgtgatttttcgccggtgaatgctgccttaaattatggctattcaattttgttatccaacgttaatcgggagatcgtttccaatggttacctcacatacttaggaatccatcatcacagcaatgataatcaattcaatttaggatctgacctgatggagccctttcggcccgttatcgattactggctggcaaatcaaaatttcaaagaattgacgccagatgtcaaatttggcttggtggacctgttaaatcttgagatgaaatttaatggcaaagaaatgttatttcgaaatattatttccgaacacgtccggaattgtttgaaatatttaagtggtgagactgacgaaattcaaattgaggtggaattgaaaaatgaggtaccgaataatgcgattaatggtaatgtttgatttgccggttgaaaccagtgagaatcgtcggaattatcggaagtttcgcaaggctttgatcaatgaaggcttcttgatgatccagttttctgtttatgtaagagtctgcgttaacaagaagtccgctgattttatggagaagcggattgcagccattgcccctcctgaagggttgattcaatcgttaattatgactgagaagcaatataacgacatgcattttattgccggcaaacccaaggaagatgttcgaaattcttctgaaaggacgatcattctatgaaaatttcgtatgccggccatcaagaaattgagctgaattcaaagaatcccacggttattgccactaacaatccaaccgtctatcatgatctagttgttggactgagttcttttagtgacaaggtaaaagtgtttgatgacaattttgagttagtggaagttaaagatgtaattgattggcagggagatgtcggactcagcgatggtgtcagtgacaagtataattctggcatttttaagcaattagaggctgtgttgactgatgatcagcgtaaatcgataactgatattaataatcaattgtatacggtcgtccagcagtgtttgtttatgatcgatttacctctggaagtcacctatgattgggatttaaagaggctgtttaaatactgtaaaattcactttaacaccgatgccatgcagaacccttatgctataattgaatcaattatcaaaattcatttagagtgcggattgaagtcggctgttggtttaactaatgtcgctcattatcttaatcagcagcaattcattgatctatccaacctcgcaagttccacgggaatctcgacattattagtagaattcacagatatgaagtcacaggagctttataccaattgcgacttttactacatcgacgaggactttgttgattggcatttataatgcattaaaattcggttataaaaaatcggttttagaaggatgttaaatcaataaggttaaaccctttctccatggtcagcaaccagcgcaagtcgttttagaaggatgttaaatcaataaggttaaacccggaaactcagcaagctattgccgacggaaagttttagaaggatgttaaatcaataaggttaaacccctacaaaaaaagaatagcagtgcaatcgctgttttagaaggatgttaaatcaataaggttaaaccctattttatcaaattactaaactcttcatcggttttagaaggatgttaaatcaataaggttaaacccttaaagttttgccaagtcaaagtcccatatgttttagaaggatgttaaatcaataaggttaaaccctccgagtttgcctttttcgttttgataaccgttttagaaggatgttaaatcaataaggttaaacccatcgcaaaatcaatataaactttatgacgggttttagaaggatgttaaatcaataaggttaaacccaaagcacagatgcaaataactaggaggctagttttagaaggatgttaaatcaataaggttaaacccgacctatatgcgatagatggtataaactacgttttagaaggatgttaaatcaataaggttaaacccagcaagccaacgcctacagattggcagacagttttagaaggatgttaaatcaataaggttaaaccccagcttaattgacaacctgcatctaacttagttttagaaggatgttaaatcaataaggttaaacccccctgccattaattttctctagttgcttaggttttagaaggatgttaaatcaataaggttaaaccctatgcacttaattttgtcacttcgtccgctgttttagaaggatgttaaatcaataaggttaaaccccttcacttctaaactgcagtccaaaagcaagttttagaaggatgttaaatcaataaggttaaacccaatttcttctttggtttggcccaagtcgttgttttagaaggatgttaaatcaataaggttaaaccctcggcgggctggatgattctcaagtggacggttttagaaggatgttaaatcaataaggttaaacccgtttctaaacgaatgtcatgccacgtaattgttttagaaggatgttaaatcaataaggttagagatggtttctcaacagatcattcattctggatcatcttccaccacaaaaaataagttctccgcctagtatttgctaagcagggaacttattgtgtttatttatttaacaatcgacttagccaacgcataccccagcttctgagctgtttgggcagttggatgaatctcatgatccttcaaagtgatgtccttgttgctgtcggtgataatgttgggtgcgatctgttggaagttgaccactttggcgcccattgacttgtagagccttgcttcagctgcccgcaagtcgtggtaggtgtagccatacatatcactcatgttgtcacgattcatgccattggcgtcaaaccgtgaaattggtaggataccgtaaatcttggcggacggattcaacttttgaatcagcttaatgttgtagcgcaggtggcgcatcacattcttcaaacttcccgaaccggaatagttggtgtaatcattggtcccgatatgaacgaagatgacgttcatcttcttgatgtcatttcggtgggccttgattgcagctgacaaatcctgtggaaccaaggttgttcccagataagcataccgattgccaacaattcggccgctcgggcaggcgaagttttcaacggcggtgttggtgccgagatacttggctgtccagtcagggtaagaactgttcaaatagaagtgatagccgtcccaacctgcaggaattgaatcaccaaagacgccgatcttttcgccagcgtatttattaccggcagaagccaatttgacgttatatgatttcgacgtaatatcggtaacagctgaattcaatacccagaatttgtacttttggttggcactgctgatccgatagacgatcttgctcttgccgccacaaatcaatttggcagcttgactccgataccaggccgtcttcaaaaacttcttggcgctgactgatttagccaaatgaacatccgtgtacagcttggcattcttcttcagcgcaaaggcatgcggatgcgtttgcgttgtgtattcaacttgaacacttgctttgtctgcggtggggtggctataaattccaaacgaaattgatgccacaacgaaggccgcaaagaacagcttgatgtgtttattaaagaaattaatcattgaattttctccccagaaaattgatatttacgaaccattcgaattattataggtaccgttccccgtacctataataatatacctactattaactttctaattatacgacaaaatacttttgaaggttataaaaaattgcaataagcaaataaaatattccaatgtgagggtcaaccccacgtgtatcaaggaaatcaccaataataaattgttttttcaatagcaattttgccggtcaccacttatcatagaagaagaggtgattgtatgaattttaaacaagttgtatttgataaagacaaagagattaaattagacatttacgatgctgatagtgacgttgcactgcctggaatcgtggtaatccccggtggtagttacaaaacatttaaagaacgtgatgctgcccgggttgccctgacctttttaaccaaaggttaccaggcattcgttgtggagtatccagttaacgaaaagaaaaattatcaagatgccaagcaaagcatctccatggcctttgattatatcacagaccatgccaaagatttgaatgtcgacaccgacaaattaggggtaatcggcttctctgccggtggccaacttgccgcagcatattccaatcagaaggataccaaagctaagtttgccatcttgggctaccctgtattaacacaggcccttgatgaaaaaattgggattcacagtgaagatgttaccaagcaagttaccaaaaacacaccaccaacatttctttttggtgctagaagcgatggcttggcaccatacatcgaccacatctatccatacaccgaagcactgtttaagaataatgttaactttgaagtccatgaatttgccactggcggtcatggcttcagcctagccaaccaatttgtcggcgtcgttaatcgcgaccggaccgatgaacactttgccaagtggttcccattgtgtcttgaatggcttcagtctttataatagattttctaccttaagtagatattaaacgagcatcaaactcagcgattggttgagtttggtgctcgttttagttagtcctatttaatcatcataactattttcgatcagaaagcgccttgataattcgaccaagatcggcgtcattggggttgaaagctcgttccagttgcgatcgacgaagggtttgaatttgttgagggcacctttgtccagctttttcgtgtcagttaataaatgcctcaactctaaagcaaattcttgcagggtcaggcgttccgactggcttttcattgattttccgaccgacatcagttgagataaataaccatcaaattcggtactttcagtttgggtatcgtcctttggaaaatcaattgtttcggctttgttttgggcacgttttaattcctgaatataggcttttcctttgtccgtcaaccacttggttgcatgattattgaagagcttgacaccatcaataaaatcaacgtcaaaggtgactgtcaggactttttcgtgagcatcgtccatttgattgagctgagttaatagcattggcgcagtatatttgttgttcttaccataatcgatcagtttctggactgtctttagatcaacatggttaggctgcgtgtctaaaaagcttaagataaattcccgcattcgatcctcaaattccattaaatctcgccatccattctatatattattaactgtgaaatagcttcatttgaatatcttgatcataattgccaaatccttgaccaaaaatggtgcagccacctttgtgcttcgcactatctttaatcgcaaatctaaccgtgaacgttggcttcttccaatcaatgtcatcaatggaaatgtcggtaaagggttgaccgtccagataactaccatgatcggtgatgcgaaccactttaagctgaccatattggttaacgttgtcgggaacccacgcgggcgtgtacttaccccgaatatcggaaaagtcacctggactggtccacgtaccaatttcaacatcattgatgtaaaacgtaatgtcagaaggccagacattgttggagaaagggaattccgacccgagttccatggacaaatccaacatttccagtttgtccttttcttctaagtagttcgggaactggtattccacgaagccgttcgtccaccaaatcattccagccttaatccgctcagggctcataaagtacttgggattgtcgaccttgccaatatagtcatttttaccagccagaccgcacgaaggggttactgagtaatcagtgaattgaccgacagggacttgtgtctcatattctgcaaacgcgggataaatggtcgtcggaaagtggacgttgatattatcaacttttaagtaggaaattttactgtgaccttcacgttcaaatccgatgattccggcatcttccagcttactcagatgcatcaggataatggtgctgcttaattttaatttttttgacaattcttgaacactcatccgctttgatgaaagtgtttggataatttgaattcgaactggacttgccaaggctttatatacctcaagcgaatcttgagaaatatctaaatccatctttgtgacctcactctcaatctgactaaatcaaccaattaacatttattgattgattagcagtaaaaacgtttaaatcaatataaatgttaatcttatttttgtaaccggttactaatcgtctttatattagcaaaaccacggttttaagtcaaaagttaattgaacatttatgttatggcttgtaaccgctttactgaagaaatatcataaagatgtgcacaagggatatcaatactacgtagtcaatcaacaaaagaggagtttactttgacagtttatacgaatccgctcattgttcagcgggctgatccatacatctacaaacacacagacggatactattactttactgcctctgtaccggcatataacctaattgaaattcgtcgtgccaaaacattggaaggacttgcccatgcagctccgcggacaatttggcggaaacatgaaagcggtcccatgagtcaattgatttgggcaccggagattcattacattgatggcaagtggttcatctactttgctgctgcagaaaccacagccttggataagaacggcatgttccaacacagaatgttctgtattgaatgtgacaatgctgatccaatgcgcagcgaagacgattggttcgaacacggtcaagtgaagacaggcatggatagtttctcgcttgacgcaacctgttttgaggcgaatgacatgttgtactatgtgtgggctcaaaaagatcctgacatcaagggtaattccaacttgtacattgctgaaatggaaaacccatggacgttcaaaacgaagccagtcatgctgtcaaaacctgaatttgactgggaaacgattggtttttgggttaatgaaggaccagctgttatccatcgcaatggccgcttcttcctgacgtattctgccagtgccaccgatgaacactacgcaatggggatgttaagtatcccggatgatcaagatttgttggacgcaagcaactggaccaagtccaagaagccggttttccaaagtgatatggcaacccatcaatacggacctggccacaactcctttacggttggggaagatggcaagacagatattttggtttaccattgccgtgattacactgaaattaagggtgatccactgtatgatccgaaccgtcacaccaaggttcagccatttacttggaacgaagacgggacgcctaactttggcaagcctgttccttataattatgattaataaattttaataggaggcacatgttatggataacagtgcaaaaatgcctgaaaagaaagagaagaaggatttttggggctttccatttactcattttacctacttctttaactggcaaattattaatggttatttaaccctttggctggaacaagttgcccatttaaatggggcagaagccggagttgtattctcaatgatggccggaatgtcattactgttccaaccagcatttggtgttatttcagataagctattatttaaaaagaacttaattatcacaattgcgatcgccgcaatctttattggaccatacttccagtggctgtttataccatttgctcacataagcaatatgtttgcagccgttattactggtatcttccttagtttcatcttcaacggtggtgtttcagtaattgagcagtatgttcaacgtgcaagtttggcaaacggatttgaatatggtcactcacgaatgggtggctccttagccgggatgtgtgcttcattcctgggcggacaattgttcatctggaaaccatactcaatcttctgggcatgtaccgtttcagcaattatcctaactggactactgatcttcagtgataaagttcacttggaaaatgcatctgcagctggtaacacttcagacaagattgactggggtcaaatcggtaagatctttaaaattaagaacttctggtacctatcaatcttctacattggggcttcagccatttacgatgtctttgatcaacagttcatcatcttcttcaagacattctttaatactgcagctcaaggaactcaagcatatagttacatgaccactgctcaaattggtctggaattcctgctcatgttcccaatgccatggattatcaaccggattggttcacgaaatggtttgatcgcttatggctgtatcttagctattcggatcattggtagtgcattgtcgccaagtttgatttgggtcattgttcttcgactcttagccggacttgaaatgccattggttcttgtatcaattatgaagtatattgctggtgccttcgatattggtgtatacgcaactgtgtatgccttagcgtcgaactttgccaagcaaatatcagtcttcatcttctcaagtgttgccggtaacttatacgatgcaattggtttccatcaaacatacctgattcttggtgccattgtagctgttgttactgtctttgcagcatttgctttgaagaaagaaaatcctgttcaagctggtgaatgtgacgaaagcggtaaacctaaagaataagcaagattttctaaatctgtgagcaccctgttaaaaccccataaaaaaagacactcagctgagtgccttttttgtgtcctaatacacctgttctccacccatccaagtctcagcaacccgaatatctttcaactcctcatgcggtacggagaaaatatcccggtcaagcacaacaaaatccccggcatatccaggagtcagctggccgttatcactaaaaccgccaatcctagccggccaactggtgtaggcaagcactgcatcgggaaccgtaatggcttcttcaggattaacaacgtcaccattgaccgcggttcgagtgactgcggcgtaaatgttcacaaatgggctatccggttcagcccatggtgtgcagggggcatcggagctcagggcaaactcggctttggtgttcatcattgatttcacacggtaggcttcattgaactgctgcggggaaagatagtgacggtacgattcatcctcggcaaagaagaaaatcggttgggtcaccagggcgtagttcatggttgccatgttgatttgtttaagcatttgattgctcagaatggaagcatgctcgattctgattgacggccggtcggatagccacggttgcagtttatcagtcacatccaaaatcaattggatcgctgcgtcgcccatcgcatggatggcaacttggagatgctgctgtttggcataggtgacagcttgcttgagtttggttgcgtccgtcaggcagactccattttggccgctcggataaggttgttgattataggcggtttcaccggaaatactgccgtccatgaagaccttgatgcctgcaacccgcaactgatcatcattcgtcggttgcaggtgggtattgccggctacttcatcgtagacgtagtaaatggatgactttggtttgaaaccggccttgacagcatcttggtaaagtttgagcgaatcatacgggcgaatgcgccccatcatttcaccgatggcgacaatgccgttttggagataatgtctggagctgttcgccatgttatcgacatcgccctgataactttgggctgatttcgccttgattaacaactgggtagcggcgacttccttcatgtaaccattcggccggccgtcatcaaaatggccaatgaagccgccaaccggatccggggtcgttgcagtgatccccgccagttccagcgctttggaattaccgattgatgagtggcaatctgaccgataaacaaaaatcggctgtgtggtggaaatttcatccagatcatcgacagttggcgtccggtgctcggctaatttggtttcatcaaagccccagccctcgatccaagtgtctgggccttttccaaaggccggtgattgacgtagggcagcttgcatgtctttgatgctattgacgttgggcggtgtgcaggcaaccccatgcagagcgtcggcaatatatttgggatgggtgtggacgtcgatcaatcctggtaagaccgttttgccgtgcaggtcaattgtctcggaatcattgatctcgtcggattcaccaatccaagtgacgtgaccatcttcaattgtcatcgctgaaacaaaagtcgtctggtcaattccagtgaatatttttccattaatgaaagttggcatgctgattctcctcgctgatttgtttgtctctattattcatgataattggtagcgattgcaagcttgatctttctggaaattaaaacggcgaaaagttatcatgatattatgagctttgagagaaggagtaacccaatggaatctttggaatcgcacaccttaaatgcattttcgaaaaatattgaactgactgaccaccggaaagctgttttaaagcaaattgacgccttttctcgccaacatttaaaagaagacgggcacgcggtgtttgttttgatgggggatgccgggaccggcaaaagtttgatcttgaatcaactgtttaccgagttggcccaagtcgttgacgatgcctattttctggtcaatcatcccgaactcctaaaagtgtatcgcgagttggctgggcaaaccccacacatgctgaaaaagtactatcagcggccgacgagctttatcaatcagatgcataagcagggcaaacaggtcaatttgacggttgtcgatgaggcccatttgttgctgagcaagccggatcactacaataactactatggtgacaatcagctgcaggacatcatcaatttaagccgggtgacgattgttgtttttgatccgcatcaagtgttgcgaaccaagagcttttggaataaagccagattggaaaaattgatcgccccatatcctcacgatttagtgcatcttaagcagcagtttagaatgcaggccggcccgaagctgatgaattggctggatcactttattgacggggatgttatacccgcgattcccagtgacgttggcgactatgactttcgtatttttgccgatgctgaaaagatgtttcaaacgatcatcaagaaaaacgaccagtatggcttatcgcgaatgacgtcaaccagtggctatccctcaaccttggatggtgggaaacatttggtcaacgaaggcaactttcatctaccttgggatcaatataatttcaccagtaccccatgggctgagcagccacaaacgattgacgaggtcggcagcatttacacggttcaggggtttgatctgaactacattgggattatcattgggccgccgttttatttaactgccgataaccgtctgggcgtcgatcccagcaaagtcactgacgtggagatcttcaagcatcgttccgacatgtcgaaaaaagattatgaagaaagtaaagttgaactgctaagaaattcattgaacgttttgctgaggcgggggattaaagggatgtatctgcacgcccacgatccacgtctggaacgttatttggaagaaatgatgcctaaatagtgacctggcaaattgattgacaggctggttgggattagatatagtttgtccatagacagaatatgagggagatcgaccatgaagaaaagaacaattatcattttggcggttcttgttgtgcttggtgcaattggcggtatctggtatcatcacaattatgcgagaatcttttactatggccaagttggcaaattggaacgaactgagaattcgcccggcaataacccggatgttcattactatttgattaaggcttacaatgacaaaggtcagggtaagacccttgaagtgggctcggttgacggtaagtatttcgtcaaaggtcactatatcaagattggttactcaagatcgaagaatgtcgttgactatgagggaattccttattcacaggtgcctaaagcagctaaggaaaagttgaatcattctaattaaatagagtggaacgcaaggcgttttgatcccagaatttaagcaaaaaatcgagttattcctgttcttggaataactcgattttttgcttaaatggccgggagcggccgatcgttccacgtttaaactagataacagtggatctcaacggaggtcgaggcatagctcattgtataacttcagatatttcataaaattcataatttttcaaaaaaattcaaaaaaatttaccaaccataacttttcacatataaaagcgttaactcgcctaatatcaagcctagttaagcccttaccaagtaattctttgcattcgctttcttttcttccattctcatcaaatgccaagaatttcgcattttaaatgcccgacttccgactacacagatttttaaagtgtgataagctctataaatgttatattttcacagttttcattattaataatataaggagtggttaagttggatacaatccatttggagaagttaaacgaattgcaagaggttattgaacggcggacaattagtcggtttgaacagatcgcggacatggcacaaactatcgatcagacagatatttgcagcgagacaacattctacatccacgacacctcacactggagtaccgattataacagcatcgtttttgatgctcatcgcggtattcacaagactaaaatgacgactaagaaactaattaaccggtacgcacggtcaaaagaggctaattttctgctgatgcaagccatgggtcgccaactttctgtaaacagatgttggccctacgtcttaggtagcattcaatttgccccaactggcggccctgtcaaggactccactcattgggtagccgtgcaccatatgaaagatatttataaagatccggcagacgaaaaacggatatatatagtgtttgatggtggctatcgattgaacgtacgagttgatttcaaaactttccaccgcaaacttgaaatggttcgccgctattacgatttccagttggatctcacaaaatatctagttggccaatttaatggtgaggtacaccttcttccgagtgatagctacctcgccacacggatcccgcgttctcctgatttagaaacatctgaatatcaaaactgccgggaaattttaatccgaattgcgcatcaagttttccggacaatgaacccggaagattaccattttgatattctagatatggaggatgtctataaggatacgttgcgagataaggcaatgttgtaaaaactaaaaaccccacaatttataaaacgacgaggagtttaaacaaatatatggaaaaaatgaaagttatggacttaaaattacccggattagctattcaaattctggtagccggtcgacacacatcgcttaatatgaatgggacaatcaagtatactgttttcgaaacagcagaagaagcacttgataaggcccatctagtgatggaaactctggcaaaggactattcggaaaagattactgtgtattatatgtaaaaacagtttttattaaagctaagcaaatctaaaaagcatcttgcctatgacgccttttactcagtcatagtgcaagatgcttttctcatttcaatattctttgaatctgcattgccattaacatgatctcttcatctggtaattcatgaccaaatttgggtctctgtcaaatcgtattggtggagattttgaacggcacattcacttcggtgaatgtgctttttgtttactcatgaattaaactaatccggataaagaagttgtcaatatttcgaaaaccaaaacagttacgctttaatgccttgattttacggttaatttcgtaaaaagtgctgcgacaatcgttggtaaaccagtgacgatccatcaaagcgacacttggacgccaaatatgagttttcaaactgcaactgacacgagtggcaatcaaatcacaaattatgaccaaattgccgatacaacgccgtttgtcattacagagtttacaacggacgggacaccaataaaaacgtatactagcactgcagcgtttaacgcggctaaagttgttggcggtttgtattggatttcattcacaaacagcggcaaagtttcggaaccagttcgcattaccgtcgttgccgatcaaagcgcggccaatgtctattatcaaaccaaagacggccaggctttagacagtaaaactgttcaggatctcgatgttggtagtacctacacgacgactggcacccaacagatcacaaaagatggcctgatttacaacttggtttcatcatccccggcaatggacgaaaataacactgtttcaattgtgattgacaaggatggtacgcaaaacaatatcacgttcatctatgaaattgcgaaggggtcagtgactgtccattacgaggatgaaaatggccacgtgctccatccaaacggctctgtatctggaaacatgggagaaacttatgcggtcacacctgttgatctaaccaatcttggttatgtttatgtaggggtaggtagtgattcggcgccagagaacgggaagctaacgaatcagaatcaaacagtcacgtttgtttatcgattcacagcgaccacaccaacgcctgaaaaagctggaactttgaccgtgaagtatgtcgatgaagccggacggaccatttctccggatattagtcgtgaaggtttcgtcggtaatggatatgatgttgctcctgctgacttaagtaatcagggttatagctatgtcggattggattcggattcagctcctgtcaaaggaagcctcacctcacaatcgcagacaattatttttgtttatcatttaaacaccgaagttccaacacccgaaaaggctggaacgctaactgtaaaatacgtggatgaagccggacaaaccatttctccggatatcagtcgcggaggtttcatcggtaatggatatgatgtcactcctgctgatttgagtaatcaaggttacagctatgttggattgggtacgaattcggctcctgccaaaggaaagcttacttcacaatcgcagacaattatctttgtttaccatttgaacagtcacgaaacgactccagaaagttcgttactgacgattaagtttgtggataaaaatggtaaagaaatccatcgtcgtttggtacaatcaggatatcaaggcaacggctatacattcacaccgttgaaaattgctggttaccgatacgttggccttgcctcaggatccgcgccattaagcggtagttttgatgcagaaaacgttgtgattgcgctggtttacgccaaaatcaatcagcaaccgggcaaaccaacgccaccaaacaaaccaattgtcgaaaaaccagacgttcatatcccagataataagacaccaacaattaatgcaaagccaatcgctgttaaccaaacagctaacccggacaatgctccacaaaaacttcagcaaaccaaggcagctactcataatgcagatcaattaccacaaacagatgagcagaaaagtttaatcgctaaaattcttggcatgaccggattaataagcttgctgggatggctgggacttaaacgaaagaaagaataactagaagttaaaaatagcttgaacaataaataaagggtgaggaaattattgaacatttcctcacccttttttacgttagaaaaacagataataaattccgctcaacccaataaaccggtaaatccactttctaaacgtctggtcatctagtttattcgccactctcgccgcaaggatcgtgccaattccggcggcaatcatccccaccaagatgtaaggcacatcatgcacatctaaaatgccattagcgacccgcacgctgttaatgtaaaaagcgtcaattaagaaaaagccttgaatactggccgtatactccggaattgatgtggatagcgacaaaaagtacagagccatcaatgggccaacaatccccaacaacccattaaagaatccagaaatcaccttaaaacaaaccgctatgtaccatggatatttacgatcacctgcgtttttaaacagcgtaaaatacaaacacaacgccaccaataaacatcccaataacacccgcatcacatgggtatccaaaacactgctgagatggacggaccaagtggccaccgccgcgtaaataataaacggcaccacgactcgttttagcttaaattcatggcgatatctataggtcaagcccaccatgctggccaacatactcaaaccggcaatcccggctgccggagcgatgggtaaaatgaacggaaaaatcgtcatcatcacaatgaccgcgccaaaaccggtcaagccttgcacaaatcccgctaccattgccgggaagaaaattaataaccaagtcaccaagttggatctcctttaaatacataattgtatctagtatggccgaactacgcgttaaggtcaatgaccacaactccacctgaaaactaacaaaaaaatgactttgccacggataaatttccgcaacaaaatcattttattaaccgtttttattagtgtgctagttttgccgcaccttgtgcctaagcctcgtcttctgtcggtcccttatctaaaaaggcgctaaccatccagatcagtttgtccatctctgccttaaatccattcagcatatcttgagtgggtaaatcctgttcttcatcagtaatctcaataccttgttgatactgatctctgatgtatctgaagtcatgatctaaatgcttcatgagttcaggcaacggaaattctccccagtcaatcacttcatctggcaaatttgtgtgctcgataaactcgtgagtcgtcgcaaatggcttgccaccaagcgcaattaaccgttctgctacttcgtctagctgttccgcaaactcttcgttaaattcatccattttcggatgcagtttaaagaactcgggtccgcgcatgtaccagtgaacttgttgcacattaacttgcaactgacttaaatcagcaattaactggttcaaatgtgtctgcgttttgggaaattgatccatggtcataaaaaagtacccctttcagttttccaagctggttttacccatcgactatatcttcagcttaaagggtttgttagggatactcaagttatctgcctactgggatttctggctaaacaaaaaaggcaaagtcatcgctggcttcacctatccttcttcaattcctagaatcaagcgaacttcttcctctgttaacgagcccttattttcggttccgctaagcacttgatctacgaaatttcgtttcttttcttgtaatttataaatttgttcttcgatggtccctttcgtaattaaacgaaaaacatccacctgtttcttttgaccaattcgatgagcccgcgcggtagcttgatcctcaaccgccggattccaccacagatcgaccaacacgaccatatcggcaccagttaaattcaaaccagttcccccggccttgagcgaaatcaaaaagatattcttctcgccggcattaaacgcattgaccatttccaagcgttccttaggtttcgtacttccttgcaggacataatgatccaaatgctgtttatccagctcgttttccaaaatcgataacatactggtaaactgcgaaaagatcaagacatgccgattattttcttccgcttgccgcaaaatttcggttaactgctctagtttaccggaatcgcctttataatcatctaaatacaaagccggcgtatcacaaatctgtcgcaagcgcgtcaaaccagccaaaatagccaacttgtttttcacaaagtttgcgccggtcatcccttgaaccttcacctgcatttgtttcaattgggccaaataaaccgtcttttgtttgtgtgtcagttcattgtataagtttgtttcgactttcgccggaatatcttttaacacaacggatttctcccgccgtaaaataaacggtttgacccgcacagccacctcatcggcagttaactgtttgaacgctttccggctaggcaagagtccgggcatgacaatttcaaaaatggcccacaattcttcgacccgattttcaattggcgtcccagacaacgcaaaggtgttttttcgcttgagctttcgaatactctgattggttttggtgctcgaatttttcacaaattgggcttcatccaacaccaaataattaattttgcgatcattatactcggtcacgtccaaacgtgcgctattataactggtgatcagcacatcggcttgttcgttttcaatcaaatcgcggcgattagccttattaccatcgataacctgggttttaatttcaggcgcaaacttagtaaactcttcttgccagttatagattaaggatgcgggtgaaatgattagatcgggcttgtctttatcaatatggtccaacaaaaatgcgatcatctgaatcgttttaccaagacccatttcatcagctaaaataccgccaaaattgtaactatccagcatctccagccacttcacaccaattgcttggtacggccgtaatatgccatgtactggatgagaagctttaatttcaaagttttccggatgtgctaagttttcggcaagttgtttaaatttatcatcaaacttagcggttccctgtaaggctgcttgaaccgcaaacgcctgtgaagcatgcactttcagttgcccgtttttaaacttcccttgttggcgaatattcaatagtgccttgctgaccttacgaaattcatcgtccaacaagaccagtgagccgtctgcctgggtgatatatggtttttgcgaatctagctgtgctaagacactatccacatcgttttcgtcgacaccttgcaacgaaaacttcactgaaagtagaccatccttttctgaaacgttcactttcggcgcgagatccttagaatcatgcaaactgtttttcaggtcatcactcagcgttaccacaccattcttacgcatgtttggcaactccagcatgaagaagttaaacattacatcggcatcatcgaaagccttcacccagacatccttacgtaaataaaaaccaagactattcaaataatcccaagcctgatcctctttttcagtattacggcgtttttcagggacctgatcaatatccttactatcaattaatttaccaccgtagtcataacttaatttcaattgcagattgttgtcttgtttgctcaaatcaaaatggggagtcatttgactatcaaaaaagtctgctgatacatccaaattaccaattaatttgaagaattcaatgaaatttttcagttctgcttccttactcttgtcaaaatgcatttgaaagcctgcatcagcggggtcacgattcatagcatcgcccatgatgttattgtacatatcaacgatccgactgataataatagcttgttgtgtagtagcttgataaaaaacattttgattaatcacaattgcacttccaaagatcaattcctgaaaatcgctttgaattgttagctcgtatccttcttcatccggtttaagagcacctttaatcaaaccgctatttgcatgaaacggctgatactcaatactatcaaataaaaattgatgatcgcttttttgaaaatggaagttttgtaattcattacataattcaataaacttaggaactaccctatccgccagaagataatatttattcatatctagcgttccgtttccatcgaaactaggcaatccggtcacagtcatgaaatctattaaggccttatccgctcctgaaaacacagtttcacccaactgaaactcattttttccggctgttttatagacaccctcatccatgtatgcagccaaaaaacgtttaagattattcaccacataaaatttattatcagtttttcttgcaaccctgagcctaagaaagagatgattttcagctgggtagttccaaccctgacttaactggccaaccatcatagtaacatcaagcaccaacggctcccgaactgtttcggctaaaggtgtaaagtatcgtttttcgggcaaatcgatactctgtaaatagcgctcacctgccaaatcagccattgattttcgcttgtgcaccatttttatctctggaaagtcaactgtagggtctgtccagtctgtctcgtcatcatcgtaactatcgcgattaacatcaaataacgtctcgattggatcctttgcaaatttaaatagttcgactactgccgctacatgcttacagaaaccattttctgcaaaatatggacaagtacagttatcattatctggatctcgtcccacagatacatcatacgcataagtaccatagactgtggcttccaccacctgtcgctcttcgtccaaattctcaatgtttacttgtccatcctgaaaaagctttttccctctgtcccaaatcttggatggcattgttctccgacgcatattattactccaagtcttaatctgattttgatcctatacttctattttacactactgttgttgaaaacggtgttgcgaaatgctgaatagttttcataatcatgcaaaaacacagatctcaagagaaagatctgcgtttttattatttttaattgattatatgtactcactttgggataacatcgggggttaaaaattattctacaactcacaagtacgcaaaaatttggtcaattcttcaaaaaagcaaagctctttcaaaaagagaattttgctttcgtttcatctagctttacatattcacgccatttcccaaaatctgttggtaattctgaataacaagattaaagtccgcggttgaaagctcgccaactctttccatttgtcttttaaaataatcaaaagaatacatttgccaagcatttacgtacccgtcaattttttgaatgatgtactttcaccgaaccaaaacgatgcttcgtatgtgtaatcgggcaaactacacacagtcctgtcagtctgttatattctgttatgctaattacaacggctagacgtctcttattaacctcattaccgggtgaaggatcaaagtttagataaataatgtcctgatagtgcggataatcattcatctttttcacgtccaatcattttcacgtcctcaaactctgatttttgagaactaatttgtttcaacaattttggatctttaaagggatttttaagcttaggcataaatacaatctctccatttggtcctttggtaacaaaataccgggcattcttgtctaattttatatttgcgggaacggtcaacactgtggaattacccacttgacgaggctttatcgtttgatctgcggccataagcatacactcctcttattaggattggtttattataggcaaagtgtatcgtatatacaatgtgtttataagcaaagacaattcgttcactgagtttttactgactgaccaccactagtaagaaagtacgcaaaaaatgcctttgttttctaaaattgaaaggctccaataaagttagacgaaaatctaactttattggagcctttcaattacgcatccatcactttttatgttttagtctaccttcattgcccgaacttcttcaataaaccaacgattgaagtcatctgtatcaatgccaactgcgacttccgcatttgtttgcccattatgataggcaccacgaatgtcagccaccgtctcaccaattgcgggaccactagtctgaatatcaatccagtagttcaccgtttggtaatattccggatgcaagaggtagcaaatcgtattcacgtcatgcatcggaatgccgccttcatggccttcatagtaatgtttaaaaattgaggccaacatattgcctgcttctcctaacgtggaaactgtctccaaggtttttggagtcaacaaggctttcatcgtcacatccaacccaatcatcacaatcggaatcccagaattatacataattcgcgcagcatcaggatctgtgtacacattaaactcagccgcacttgtcatattaccacggccaagtgctccacccatcgccacgatacgggtaattctggacttcacttctggatggacagctaacagtaaggcgatgttcgtgtaagcccctgttggcactattgtcacgggctttgaactacgcatgatggtcagatacagggcctccattgcagagtgctttaccgtttcacccacaaattcatcaaaatcataaccgggcatccctgattccccatggattcttgccgcatcttcaaacggcttaattaaaggttgttcggcaccactagctacaggaacttttttgtcgaagaaatggactagtttcagcgcattccgcgtcgttttatccactgtgacattgcccgccacggtcgtgattagccgaacgtcaaactcaggattgttcaaagcaacggagatggcagctgcatcatcaattccaggatcgcagtccataattattctagttgtcatgattgtttgtgacctcctcataaagttggtttccttagttccattgtactggtttctcgcaatttgaatagccctaaattcgttccgcaattatcaaaaaacacttctggtattacccaaaaatatttttataacggtttaaattggtactggtgccgacaagttcgccttgaaccacgattcgatttggttcattgtagttcgccgaagcacaggtaatcagtgtgaccacttttttaccaggaacatctcgcaatacttccacttcgtttttggggacggtccgtttgctgtaggtacggtaacggtaaacttttttcatgtccgtaaggtaaatcatgtcgcccacccgcacccgttttaaaggtgaaaacagaatccgcgtattcgtcatatagtgcccagccatggcatagttgcccttgcccatctgttgatcttccgacatggtgccggcacctcgtgacagggcctgattgcccaatcctttcccaatgggtaatcgaagcgacacattaggaatcgcaactttgccgaccgacgcatattcagaagcattgccactctgtatggcgttttgagcggcattttggacagcatctaaactaacgctaactggattcagcattttgactgttgaataatcaaaattagccgattttcgtttggctgcttccaccttttcagcagtcatatcatccacttcttgatttcccatgtgacgaatcagcggatcacttaacagcgcaatcagcatgatcagtaaaccaaataagaaaatcaatcccagcaaccatccttttagttttcggctcatttagctcaccttcttctgctcttgcgtttgtaccaacgataaccaccatatgttgcgccacctgctacaaggataccgagaccaatccacaaccatggaatttgtttctttgctgccggttccttttcgtttggaatgcgatgcccccggactaacaaacggtgggtattgatcatgtaaggtgtacaggtcatcaacgtcacatagttatagttatcatccctttgaaaattatctagttctgttggcttgaccgttttgatgcgatccaccttgtaggtcatttttttacctttagagttgatgaagaaccgatcgccaactttcatttttggtaagtccgtgaacagcttgcttcccggcaaaccacggtgagccgtgaccacgctgtgggagccttttttcccgtctagcgaggacgttttttccataagaccagcgccttcacttaattgcagatcatcagtacctttaaaaatgggtaatttagcgtcaattccaggaatgttgatggttcccagcatttccacctgcgtcagcatcccattcattacgttggattttttgtttttatccacttttttgacattaaatttttgaaacggattcttcagccaagaccaagttttattaagtttggaggtcgaaactacgacagcctgtttgctatgtcgtgaaacagagttataggtatcaatcatgcgatgttgttgctgttgtgacatagcattcgatacgaatggaaagacaataatgctcagaccaattacaaatattagggttgcgagtgttcgttttagccattttcgtttaatgaccagcacctcctttggaaaacagatttttttgagctatgtatgacaataaggatgaacaagcatccttattgttgaaactttatgtggtaaaaattagttagcgattaagctaatttgtttttacgtgatttgtagtaatagtatccagatccacccatcaatactgcaccgataaggacgaatacccagattcccataccaccagtgattggaagaccatatgttgagttttcgatttcttttgctgcagcagcttcagaagtttcactaattgtaaatgaaattgttttatctaatggtgcatatccatctggagcttttgtttcttcaagataatatgtgccataaggcattgatggaatattaaagccaccctttactcctgtgtcacctgaagtaaacttagtcgctttttctgttgtatctacccatccgacgaatttattggcttcaaattttgcatattttcctgctccaattgttgaattattggttacatagaattcagcaccgtttaaggcactacgatcgtctccatccactttcagaaagtctttttcaccaaaaactaaatagttttttacagaaaaggtccaaacaccatttacttgatttactgttacgtcatcaggagtactgctggtaattgagatattaccttgtgaaactttaaacttaattactgcaggcgtataaccatccacttctgtttccgttaatgtatagttacctgctgataaatttttaattttcaaaataccgttttcatcagtagaagcttctacaggttcaaagttagtcgaaccatctttagttaaggtaaattcaatattctctttaagttcaaattcacctggttgatctttatcttccattttcttttctaattccggatccgttttaggtaccgtatttttagcgtataaatgcaccgtttttccggttgcagccgctaatggaagactaaaaacagttggaattgctttagaagttgtatgatctgtatcaatatatgtttccagaatcatatacttaccgttatttgtaatattggtaaaattaaacagattatcattgatttcagatgttctggaatcaatagtctggataggagctgatactcctaaatcagctaacaactcatcttgttctccgtcaaagttcaaaatatattgttgaaatgcattgaatgcttttccatcatcttcatatgatggcgttgtacttttctttttccaggcatcaaaggctgcatctacactgtagatagaaaatgcaacatccccatcgtcttctcgattccaatttgtataatcatcaagattatctaactcagcaccagtatttgtaatatctttggcgtctttacctctgatcattttatgcaaactgacggtaaccttatcatctgtttctgccgcacttacgcttttcacgctagtcattcccagtgctaatggtgccattgctgccataaccaacagtcctgctccgagcttcttgaagagcccttttttcgttgatttcatatattcttcctcctcgtattctagctattaccctctttgattttttgcttacagccgttgaaaacttgttctattatctttgttgaaaaaattttatccgcgccgttccaataccagtgggagaataatccaattatccatttgctctacctcacttttttccgatacatccacatgccggaagccagtaccatcaagccaactagaataataatgaggtcacctataccaccagttattggcataagttggtgcagttaaatgattattgaaagtcactaatgttgaatcgccatcaatgactaagagatcaatttcaatcgatttttgactctcttgagtatcattattgtatgtgatgtccgttttataaccatctgcttcaacttctgtcacagttactttggcatcttctgggagatccttaattgtgacagtttgaccagcggtaagttcaattggagaagtcgattcaccatccgaattaaacgtgatttcctgttcatcgttgccaattgtgtatttatagataccttcttttgcgggatcaatcttcaagtcaaacttaaacttagtatcatccggaacagcaccagagactgtttttttgatttgaagatccttggttcctggttcttcctcggtaaatttgttcacataatctacaagctgactctcacctttgtctacggttcccatcacaattttgccagtgaattttccatcaatagttgttccgggatccgtgttaaatgtaattgatgtgcttgtaaatggaccatcagtttcctcaatcgagaattttgatccatctggtacaactaaggaaacgaactgttcatgtcccaaggtaattgtctcagattccccgtttacaaatcgaagctcacgatctgtgctttcaccactaacacgcatttttaaaacacctgtaaaattcggttcatctaatctcgtaataacaaactggaatttttcttgtttattctcgtcactaccttcaatcgtttttcgtagaactaatctcgtttcttccggttcgggttctacctcggtagttggattgtacgtccaagaatgtgtttcggcagatgagccagtatatgtgttagccacaattgttccattaaagttcgttgtactagtaacttcttgagttggtgctaaaatcgatccaaagaatatactacccaccagttgaactttttttacatcttctggaattacccataaaattgaataattaaatctttgattctctccggcttcagggtcagagccaactcctacaccatcaacaaaaattttcatgtgtgatgcgcccagtccgccatccgcttgaggcgtcgcaataaaaattaaattttgatcatctcgtaatctaatatctaattcttttcctgctatttgcgcattacttactttgataacaaaagtgttttgtacagcttcgtcttcaaagtttaatgtcaacttattgccatctgttgtcagataacgtgtgtcatcaaaatcaattgcatacggagttcttgctaactcgttacgagtctgatgaagcgtggcaagcgtactagttacatcaatccagtttccattgatagccgctccagtaatcgtattaccagagttttgatactgatattcgactcttcctgtatttaatggtccaccagtcaaaaaagtttgtgcaccattattaatatcagtcaaagaatggtcatttccgaaaacggcagctctcatagtaattcgatctcgtcgaccatcatatgagtttacataactagtttcttgccaacgcgtgtcacgcttctcattaccaatttcggcatgacttgttaatgagttaaccgcaaagtttccacttgtatgagcttgccccccattagcaaaattttccgcaaaaatatggaaatttgctgcaattcctaatggatttcctgttctatctggtagtgtaggaattgggatttgttctagtggtcgcgttgttttagtttgcccactttttgtagctttcgttgcctttgaagtcgcatctgtggcatccgcatcatctgattcagattcgctctcactgctatcctgtttagtttcggattcagtttctgattctttttcagttgatgtactatcagcagattctgctttttcattttcaacaggtgctaaaaatgataagcttccaaagtttactgcttgcgttaagccactaaactgcatttggatatctgccttaaaatcttccgcaatcgtttgaatttccaacggcaaggtgatttcgtagtcaaacacttgatcatctgcaatgttttcaaattcagacttgttccatttcaacatgtaactactaaattcagagctatatttataattcattttaggtgccgttgaaaatgtgccattcacaacttcgggcgtaatttcttgggttgtactcgacaattttaatgtgtcggttcccaacaacttcaggactgtaccatcattctctcgtgcctgttttccagtcatcttcaagtgaaacttggcattcacttgtttatcagcatcaacctcctccaacttttcatcattttcgttcgttagttctgtctccgtaattctaaactggtcagtttgatcttcttcggcaaaggctcccgtggcagggtacccaattccaaaaagtagcaagccaaccattagaaccgagtagatcttcctaatggtcatacagctatccctcctaaaacacgaaacggcaacgttcaaatttatcacagtaatcttatggttactattactttaatttgagtatagcaagcgttttatatttattgcaaatttaatctatattaaccataatttagatctaattatcatttacataaagtaagcgttttataaaaatatgtaaaaaaatagtgaatattctgccaaaatttctcaaaggcacgattattcactacttttacattgttttgtgacagtttttagatatctgtcactttattactcattttaccaactaaacagaccaaccacgccggccgacattaacgaaactagcacaccagataacagcatgtagcccacgtttttagagatcacatcgttccttttacgatccacgattcccttgaacgctccgataaccattccggtagttgaaaggttcgcaaacgaagttaagaagacagtcaacattgctttgaaatgaggggcataagattgcacaacaggtgaaacttttcccatcaccacgaattcattggtaactaatttggttcccatgaattgggcaaacttgaaggctgttggcacatctaatcctaaaagccaagcaaatgggaacatgataactcccaaaatattttccaaagttagccaaggtgcgattaactgcatgccagaatcgattaatttagctaacgccacaaaggcaatcacgttcgctaaaataatcaaaaccagtttaccggcacctaaaattgaatcacccaagaatgagaagaatggttcttttttaggtttggcatcagccttaacttgatcttcagctaattcttcggagccacttggatcagttgtttgcgtattttcagcaacttgcgcactgctaccaattttagcaataacatcttcttcaggtgtcaccgtaacaggattcaaaataatcgtcacaataattgcattcacaatattaattggcactgcggcaatgacatactggccgggcatcatttgcatgtaagcacccagaattgaggccgtcacacaactcatcgacatcatggcaatggttaccaaacgttgagctttcatctgtttcaattgcaaactcgaaacagcgagcgcttcagtattaccaagaaacatcatttcaactgcgaagaaagattcaaacttaggttgacgggtaataaatgctaatccgcggccaacccatttgatcaaccaaggtaagaaaccaatgtaagtcaagatatcaaacaatggcacaatcatcaaaattggtaataaggaacttgtcacaaaatccatttgtttgacgtttacccagctagccaaggcaaaaccgatccctgaataggaaatctgaaccatccagttaaacgcatcagcagcggctttaacaccatcaataccgatcgaaaaaccagttaagaaccaggccaagaagacgttaataaccaacatggtaataactgaacgccaatcaacgtgtttcttatctttggagaataaaaatgcaacgccgataaaaacaagaataccaagaatattaataagcaaatacatgtctgcgggctccctctttctatgtataaatcccaataattgcaacggtccttttataatataccgattatgtagacccctgtaaacaagaaatatggataacccctaaataacttggtttaaactaaaaaatgaattgtttggggattaaatagcttgttccttagaaacctgggcgggaacacaacggacacaactttaagccaaaaaaatcttaaagatcgacctttttgttagtgctaaagcaccaacaaagatttcgttgctaagccagtttctattttgcaagctatttagtcttcaaacaattcatttaaatcatttagttctttgtttcactcagtctctgccaaaaattactgatatttttgcccagttgatcgaccgaatacacccgttgataatgttgccagtggcgaggaaacaggtttgtatagcgtcgtgaaccaaagcggttatccatcaacaacacgttaccggcatcctcattactgcgaatcagccttcctgccgcttgcagcacatgattcatccccggcaattgatacgcatattcaaatccttttccatttttgtcattaaaataatcacgcaacaaattgcgctcatcactcaagcctggcaacccaacgctcacaatcgccacgccaatcaagtaatcgcccactaaatcgatcccctccgaaaaaataccgcccagcacactgaaaccaatcaaggaatggggataatttttcgcaaacgcgtccaaaaattctttccgcgccgtttcgtccatttgattgctttgttcaatcacattaaattgttgatactgatctaaaaatgcattttcaatttgcgtcatatatttataggagggacaaaaaatcaaatagtttccttttttggcgttaaccatttcaaaaatactagtgacaatactttgcacgcttttatcccgttgattgtacgttgtattgacatactgtgtgatcaaaatgttttgtcgctgttctaaaaacggtgaggttaactgcaaacttaagccagtcgtttcacagcctaaagtttctttgaaataatccattggcgacaacgtggccgaaaagaaaaccacgccccggcccattttaagagacatatccaaataaggactcggatccaaacacaattccttcacactcacactttcatcatcattcaacgtgacaatgacgcgataactttcgtcgtagaacgccgaaattttgacgtatcttaacaaggtgaaatagaaatccaaaatttgggaggtgaacggcgttggttcttgtttagctaaccagtccgacacaaacgaattgaatttttctaatccatgacgaaaactatccagttcttcagtggtcacagcctttgttttatgttgttcaactaaaggtaacttaacttggtcaaaaacggtttgcactttttttagctggtttgaaattccctggacatcttcattttggctggcattcttagcagcctttaagagattatcaatctcacgatcatcaacttcggccgtatacatgtcccgcgatcgtgaaactaagttatgcgcttcatcgaccaagaaaaagttgctgtcatccggttgggagaagaagcgctgtaaatacacgattggatcaaaaagataattgtaatcgcagataatgacgtccataaaggtggaaatgtctagcgaaaactcgaacggatccagcgtatgtttcttggcatatttttcaattgtgggacgcgtaatttggttttcgtgctcaaacacatcccgaatgccgtccttcaaacgatcataatagccaatcatgtaaggattatcttcaggagccacatcaacctcctcaggaaaaataatcttatctttggcggtcagtgtaatgcttttaatctgcagacctttatccaccatgagttggatccctttttcagcgacacttcgcgtactttgtttggcagtaagataaaatagccgatcgctcaatccttcgcccatggctttaacggcgggaaacaaagttgagatagttttacctgttccagttggagcttcaacaaaaaggcgtttttttagggcgactgttttatacaccgcaaccgctaaatcacgctgaccattgcgatattcatcaaacggaaaggccaattgtttgatactttcgttgcgtttcttacgccaatcgctacgcatgacaagccaattacggtattcctcaatcagaccatcaaaaaagtcttgtaggtcttcacgcttatacacatgttcattttgcgtgattttgtcagttgttcgctggtaataggtcagtctcaacgtcacttcgggcatatctaaatcgtgcgtcagaattgccccataaactttgacctgactccaataaagtgtgagtgtgttttccgacaaatcttcaaaatcaggatccgatgttttaatttcttcaatcactaaactatcgttagtttgaatgacaccatcggcccggccatcaatcacatagtcttcccccgccatcgaaactgtgcgtttgacgtagacttctttttcatagttttcaccgcctgttttttgcagtttgcgatgaattcgagcaccttcgagggctgtgttttggctgttactactggaactgaggtcgccggcacgaagaacaaactccaccaattgccgaattccaattttattgcctgccattcgtgtcgcacctccatccattccgtttctgtaataactagacttacttttaaaatatttttgttaaagtttcgtaatattagcttgttatgattattaaatcagttcaaaaaataaggagttcacatgaaaactaaaactgcactacccattttactattctttacaacatttttggcaatcttcttcgcccaatccagcatttcggcggacagcattaaacctatccaaggaattcaagcaacaagtaatcatacaaggacactatccactattagtcttaaacaaaagggtcaacaaattaaggctgattctaagcctgaaaagacagccgctacaagtgacaagactagcacagctaagtatagcgatctaattagcttacttaaaaaacagcttggcaaaagctatgtgtacggtgcggttggcccagacactttcgattgttcaggattaacacaatacattttcaaaaacgcgctcaataaaacattacctcgaaccgctcaagcacaatataacgcttttgatcacgtttcgcatagtaatgtaaaaccgggcgacttggtatttttcagttataacggtggtgccaccattgatcatgtgggaatcgtagtttcaggcgataaccaaatgatagatgcacaagatcgtggtgtcattaaggaaagctatatggcatcttattggaaaccctatattgctggatatgcccacgtaacggatttggattaaacttcagcagcataacttattagacttaaaaaacacaatagactaggcaaaatagcaatatatgcctggtctattgtgtttttatatttaaagatccacatccatgataattttattttcttttttgaagatattttgtagctgaatcattttgctgtttgtagcttgtttattgttgcgaaaatcccaagacaaatctaaataaacaagtttgccatccatctgcttaatctccaaaatatgtggtttaagcatccagggcataaagacctccggaatataagcaccaaacgccaccacatccgaagaatcctttacctatgtccttgaaataatgcgtgcagtttggatgttttcaaactgaatacttctaaaattattttgcttaggaaaaaggatgatatgaagcttttcaccatatgttttcataggcaaataccgaataccgttttctgaaatcatccaccgatcgtaaagatggaagatataagttggataataaaccaaaaggagtgccagaatcacaccaactccagcaactaaagctatccaaagcggtactgacaatgacattaagaaaaaaaggacaatcaaaccccaaattggactttttatcaatggggcataacttggttgacgaccaaaataaatcttatctaccatactgctcacttctttcatgcaatcaactatctgaacatttctattaattcaccctcattttaacacgatagcgttgaaatgataacgctttctatgaaagttcagctttggcttatcggcattctcatcatttactcatttgttttttaacattgtgctaaaatagttctaggatgacaaacatgaaaaggaaatgattcataatggggaagtatcttaaagcaaactggcaaaaagtagcacttttaatttttttaatggcaatcaccgaacttttcactgttttagcgtctgtttttaatgctaattcattaaatgcactagtcgcacataatttgaaaaactttttttaccaaattttatttcttttactagtttgggtagccgttatcttctttagttacttagtggctaattacactcaagtagttattcaagacatcgatatttcaattcgccaccatatcactaaaaaaaatcgaaaaattatcttataaagaatttcacaataagaatactggtgcttatgtatcctggttaaacaatgacatcacgattatcaattcaagtggtcttaaaagtctctttactgtcatcgaaggtgtttttggtgtcacgtttgctctaattactttgactacctaccattggagtttaacgttaacggcaatcgtaatggcattcattattattttggcacctaaaattatggatcgccgacttcagaactcaaatgaggctttaaccaaagaaaacgaacaatttgtttctcaagtagaagacgttttatccggattcaattttttatatgctttgtttgcccttccaatggtcactcaacacgttaaaaaagcatctttagaccttaaaaagcgaatgtccacctcactcgaactcaaacaattgtacaaatcatcggatttaccggcaacgtcttgtcacaagttcttttgattgggattagtggctttcttgccttacatggctttgtcaagattggaactttaatggcggttggtgctttatctggcaatgtgttcaataatttaggcaacatgagtacttatctaggcagtatgcgtggtgtaaaacctctgttcagaaaatatgatcaactaatcccttctgatcgtctatcaaaggaaaaaaataccgtgccattagcacccagtgtcgctgctattcaagcattgaatgtgtcatttaaatatcaggataaaccaataattcgaaatttttcttatacttttcttgctcaaaaaaagtacctaattcttggtgcaagtggtacaggtaaattaacacttttaaaactaatcgctggttacaatacagattttacaggtaccctttctttgtttgacaaaaactatcaagacctttcccagcaaacaattctaagtcgtattctttatttggatcagcaaccacggctattaaatgcaacggttcggcaaaacttacaattgttagatcacttttctgaggaatcactggcacaggttttggtggaaacaaatctaattcaatcattggcggatgcaccacaatttctagaaatcaatgttggtgaagacggaattaacttgtccggtggtcaaaaacaacgtctagcactggcaagaggcttactacgtcacgatatcaagattattttaatggatgaaagtacttcctcagttgatgctaaaacagctgcaaaaattgaagccgacttactaactaattctaatttaacggtaattatggttagtcataccccacatcaagaaaacatgaaattatttgatgatattatcagaatgtaaaagaaaagagagtggcaaaaaggcagtcagattccggacaatgtccattcttgtggcggaagaatctgccttttccctcacgttttagaaataatattcgcgaagtataaagaggacggcaaaagctatgtttttgccgtcctcttttttagttagtccgtttcaattacaaattcttatccatattgaatgtaagctttgataatccggcgccctgcaccacaaggctgccaataaaatcaacagtttgtttacgcatatctgcgactaaggctttgttctgggcagttaaataatcaatcaaagtctgttcagaaagttcagctgctttgttatcagtcgtttccaaatgacgacgttgtgtttcgcgaatagcagttaagtaatcacggtcactttgcacaaactgggaataatgactttcaaccatcatggataacgaccggtacatccagtaagcatcattgaaattgaacttcattgaagtgtgcttgtaagtatcgtccgtgtcggtagcgttactgtaaaacggcacataaggactgaaagatgggacaccgaagttcaaccagtaaatggcagaaagctcatcagggacaccgttgcgaatttgtaaaacatgcgaattttgcgttctattcattgaaattggccggtaacgatatttgtccgcactttcgccaggtgccagtggatcaaactgtgtttcgttgtagtgggaacctaaaatgaattcaacatcttccaccgaaattttgtgaccagtatgacagataaatggtaattcaccagattctggatcctgttcaatttcgggattcagatatttttgagcataccaaacccgtggcgtattgtaatgacggtctttttcattaaacgtaccaaaaatatgacggaagttccatccctgatcatccacgtttaagtgatgtttttcgacgaactcctgaatcccatcggcccacataaagttgttaggatcatcaaaatcaacttgctgaatagccacttcattggcagccaccgcataggcatcatccggaatgcgttgggcgacccagtaatgacccgtgacaatttccatataccacacgtcatttttatcactaaataaaatactgtttccggcattggacccatatttggcaattaaatctccaagccgcttaacccctgcttttgcggaatcgacatagggaaggaccatagtttccaacgagtcttcgcccaaaccatcttcgagtaacggatcataagctaatgtccgttcgttaccataagtgctttcagtggcactcacggctacgtttttttcgttaatcccactctcatcattcacaccttcgtgtaattgactcggatcagcatccggagttgccgtgtaccgatagccattttctggcaattgagcttcaaatccatttaattgtgatttcaaaaccactttttgcccttgaacggccggatgcatataaaattttttcggatgaatgggtaagtaccgatcctcatttcgagcgatcatggttgagccatctaaactggcctttttccccactaaaactgatgtacacatgctggttactttgttcatgtttcatcgtctccatttctgtgttaatatgcccattctaccagaaagcaagcctaaaaataagtcactgagatcctgcttcatattcaggaccgatttaccaatctttcacatcttggtgaataaaataagtttgtccgcaattaatttgcgtgacaaacttatcaaaagtctacttatttatttttatttcgtcttgcaatcattggcatgatcaaaccaagtgcaattaaaacaattggtgtcacaatattcatccctaattgtaagaaccagctgtgtggattagctgaaaaactaatctttggtaccatacccaaaacacagacaaaagcggtaaaaatgaaacaccaaaaacctagtaaccaaccaatcgtcttgttcttcacaaaccgataatcggaatggaatttcgtcatgtgcttactcaacaacataaaggcaacaaacacccacagataacgaagcggcataacaattgaatttagatttaaaagccaattatacagttcttggatgtttttaattcctaatgcaggaaccataattagaataccaaccagcacaccagtcatcttgtaaccattaatgaaaacaccgtgtttattgagtttcatcaatgattttggcacatactggtcattatgcccagaaagcaaaattcgaagaggcgcatcaattgaaacgattaacgcagcaatttgacctatcgaatttgtcagcccatacgtaatcatcaaggtgtttccaatgtgataatattgacccaatcgctggaaagcactgtaagctccgttcatcattaaatccttaggaattgcgttactattgaaaataatcgccattccaattgaacctacaattgcacaaattccaactaggactgctaaaatgatcattccgagtggaaactctcttgaagcattacgcgttttgttaacatatggcgcaattttttccgaaccaccaacagccaataccaacatcgataaagtggtaaagtaaccgaaattaaagtttggaatatacgttttgactctcgtcaagtgtgacgttgcagccgttacatttggtaaatgtggcgcagcaatcgctaaaaagataaacaggatggacattacaaatgtggctaatccagccaacgtcgcaattacacccagtgtggtaattccctttgaagcaacccacatgaaaaatagaaaaacaatcaaacataaaattgaaaaaatagctgttgaaaaatgactaaagtaggttccagctccagtaaacgcccaactgattgcaattaaaacattctgtggcttttgtgctaaataaggcacatgaactacccaatacgtccatgccgcaaagtaagctaaccctcgggttgatgtttcatcaatccaagaactcacaccacccccacttttcttgaaggtggatcccaactgtccaaccatcaatgtgtaggggataaagtaaataatcagaataataacccatgacgtaatcacggatgcaccttgttgcgcataattattcacaacgttgttaaatccccaaacagtgttaaacgcgattaaagcaatcgtaaaccagcgaaactgctttgtacttacattcgtgtctcccaatttaaccagctccccattatatttattttcttaattatagtagagaactgtaagcggttcatgtgaagttagtgagcgctttcacaagttactaatttcactctcatttttgtattatttttctgacgctaggtctttaagctgttttcgcgagttataaaaattgcgatatgccatataacaagcaatcacagatcctaagctcgtggccgacagtaacataaatgtcaccataatttggtacttaatcgcatgcactggatcaacacctgcaaaaatcaaaccggacatcatccccggcaaactcacgatcccaaccgtttttgcagaatcaatggttggggccatccccgttttgatactttcccgcaaaatgccaatcgacgcatcccgcagtgaaccacccagtgctagtcgttctaacacactctgccgttgatcgcgaaactgcgtgttcatactgcgataactaagaccaattgccaccatggaattgctagcaatcatgcctgaaattggaataacttgcgatggaatcagtttgatggctcccgataaaattaagacacccagtgtcactcctgtgctgactaaaatggcgacaaacgaaataagtaatgcgttagtcatcccgttgctacgtttctgagcattccaagatgcattaaaaataatgatgagcaacatcgccaacgtcaaaataacgttgttcactttgaaaatatacttcaacaaataaccaacaacaaacagttgaatgactgcccgaatgacaccaataataatttcacgatcaatacctagtttttcacgataaccaatccacagcgcaatcattactaataacatggctaaggtaagcgaccaattattcacatctaaattcatttttatgcctccaatctgcccttggtaattgttaataaccgacttgcctgctttaattctgccgcatcatgggtgatcgacaaaatggtcacctgatgatccttatgaaaatgttcgattaactcattaacaatccctttattttcttcatctaaaccaacagtcacctcgtccagcaataaaatatccggcacatacataatgttacgaatcatggccactcgctgcttttcaccgcctgaaagttccgtgatgcgtttatccaaatagttttctggcaatccgacaacttttaaagccgctttttgtttttcaacgtcaggagtggtttggcgaatctgaaacggaaagtctaaattgtcagcaacagtttttccaaacaaagtaggctgttgaaaacagtaagaaacttggcgacgatattgaatcggatccatttcagcaatgttttgatctttaaataagatgtcaccttgcgtagctgtcagcagcgacgcaataatacggagtaaggtacttttcccactacctgacggccctgtgatcgtgatgtaatcctgggtagccacagttaatgatatatcctgtaaaatttgattttgttcaacttgataacccacatgatgaagttctagaattggtttcatactgtcatcccacattacttggtttcaattttcagattaaatctacagtcaaagaaagttgattcaccaacattatacattgtaatcgttataaattagaaagctttgtacttaccctgcctctaaatgttataatttgagagaaagtagtgggaggagtttttaatcaatgcaaactgtatcaatgatcgtcccgtgttttaatgaacaagaatctgtaccaatttacttcaatgcaatggctaaaatttttcagaaacctgaaatgcaaaactatgccttagaattgtggttcatcgatgatggttcatcagacgcgaccttaagtgaacttaaaaaactaaacaaacagtatcctgatgttgctcatttcgtgtctttttcacgtaactttggcaaagaatcagccatttatgctggtctacaagccgcaaccggcgaaattgtgggattaatggatgttgaccttcaggatccgcctgaattactaccccaaatgttacaagaattgagcactggtgaatatgacacaatcggcacccgccgtataggtcgtgaaggtgaacctgcatttcgctcatttttatcgaacctattctacaaatttatcaacaaaatttctaaagttgaaattattcccaatgcgcgcgactatcgtgtgatgacacgcaaagtggttaataccgtgctcagcatgcccgaagttaaccggttttctaagggaatcttcagctgggttggtttcaaaaccaagtatctcgacttcgaaaatcgcgaacgagtagctggtacgacttcatggtcactttggcaacttttcgaatattcattagaagctatcatcgatttttcagcagctccattggcgattgctagttttgtgggaatttttgcctgcgtcgtttcagttttagcaattattttcattatctttagaacaattttctttggtgatccaacaactggttggccttcattagccgccatgattctgttcatcggtggtattcaactattttgtctaggtattttaggtaattatattggtcggatttattccgaaagcaaacaccggccaatttatgtcattaatgaaaagaaataactctttaaaattgcaaaaaaggcgtttggaattggtgtgatcgtacatacccaattccaaacgcctttttaagttttacactaactaatcttcatctgatgaaccgaagtgtcgtttccaccatgattttttctttggtggttcttgtaatagttgttcattcttcttggtcatttcagtcaattcagttactttttcttgtaattgaacattttcttcatgatactgttggttttgtttaactaattgcgccaacatttctttgatttcggataaatctttgttttgggcttgcaacatttttgtatcaatcactgctggtgtcttttcatcctttgcagctttagccttatccgcagcctctttatcagtgattcccaaagtaacatccacagcttgttttaaggtgtgacgatcaccaagtaaatcattcatctgttgcaagagtttcatgtcagcatcggcataaattcgccgtcctcgaccatcatgttggaatttatgacccatccgttccatttcttttgcccagttacctaatgtagctaaactcccgattcgttcgactttgtgaacaacttcggaacctgttatgtattcatctgctttgatatcttttgccatattttccacctcgcttttaacttaattgtactacaattgcttccaaatttgaagttaaaattaagttaacaaacgcctatttttcaggactcttatccatttttttgaatttaagcaaaatggtaaataaaattaagcctactatttcacttacaaaaatcaaaacggccatgggtgcataactacttgcgcctaacgctcccgcaagcggtgtgaaaacacctcccacaatattcatcagtagtcccaaaacggcggatgcactacctgaattcttatcctgactgttcattgcaatcgatgtgactattgtgttcacgacaccaatacaaatcacgatcacaaataacggaaccgccaccaagaacatattaggtgtgacccctaaactacctaacatcacgactgctgaaatggctcctaagattaaagaactgcccaaaacctgaaagttagtaagtttggcagtgagataagccggaatgttattaccaataatgatccctaatccatttaaagcatacagtaaactaaactgttgagcggatagatgaaagaagttttgaaacacaaaggatgaggccgagatataactaaataaggcaccaaaaacaaggccctgaattaacgcaatcaacataaagtcgcgtttggtgaacatcgctcccattgatttgaatccttgaaaaatactttctttacttcttaagctctcaggtaaggtttcttgtagagttaaccagattccgataacaactaaaataccgatgatagtcagtaatccaaatataccacgccaggtcatgaagttcaggaggaatccgccgataattggtgaaataataggaaacacgccgttcactcccattaatagggcaaaaaatttggtcagctctttaccagagaacaaatcacgggcaaccgctctggatagcacttgtccggcagatccagctaacccttgaataaagcgtaggattaaaaaagcttcgattgagtggacaaatataattaaaattgaggttaacgcaaaaacagcaaaaccaattgatagtggcatgcgccggccaaaatgatcacttagcggacccacaattaattgacccattgccaatccaattagacaaaaggtgatactcatctgaatcacggatgtttgggtacgaaaagcggtttgcatggttggtaaggccggtaaatacatatctaaagataaaggaccggttgcactgatcaagccaagaaaaaaggttaaccagagtttccgatcctttgaaatttgttcatttttcatggatacaactcctgctttgaaatagcttcaaagcctagtgtaccgaactgaggcaaaaaaaccaaattagcttggtaatttcccgtctttccaccagagtttgactaatgcttgcgtgccattgtttcctaggcccttttcatctaccaaacgagcgtataaattgcgagcagcatcagtagctgtcaaatttaaatgcattttgtcggcctcgtttagtgcaatccgcaaatctttcaagaaatgtttggcaaagaagcccggtgtgtagtcatcttttaagattcgaggggcatagttttccatactccagttatccgcaccgccgctttccaatgtttggagaacttttggcaaatcaagtccggccgcttgtgcgtaaaccagcatttcactcattccagtcatcgttcccgcaatcataatttgatttgccatcttcgcatgttgccccgagcctgctaaaccaaagtaattaacctgttgaccaattgccttaaaaattggttgtaagccttcataggccgatttatcaccaccgaccatgatggttagggtccctttttgcgcaccgatatcaccaccagaaactggcgcatccaaaacttgaatttgatgttctttaccgtaagcaccaattttttttgctaaggttggcgtgctggttgtcatatcgaccaccatttgaccagctgttgtccccgcaaaaattccgttatcgccaaaatagacttcttcaacgtcttgaggaaaaccgaccatggtaaagacaatctcactgtcctgagccactttcttaggtgactgcacccaagttgccccggcttttacaactggatcggcatgtgcttttgttcggttaaacacggtcaccgcataaccggcctttaacatgtttttgataatgccactgcccataacaccagttccaataaacccaatttttttcaaatttgccatctcctaagttttacaatcacatcatacgcatttttttgcgaaaattacaccatttagatttagcaaagtaaattttcatccccgatttctggtatgatagaccataagatcgttacttggaggaatgcaatccatgtcactacatttacctgaaaaaactattttaaccaaccttgttatggtagaagatccggacaacaaaaaagtcttacttgaaaatcgactcaacaaaaactggactggtatcacttttccaggcgggcatgtaaatcccggtgaatcctttgtagaatctgcaatccgtgaggtttatgaagaaaccaatctccaaatccagaacccgcaattaatcggtgttaaacaatttatggctcaaaaagatgttcgctacatagtgcttttgtttcgaactaatcagttcaaaggctctttacaaagttccaaagaaggcgacgttttctgggaagatccttatcaagtcaaacaagcccaggctgttgatgactttttcgatctacttcaagtcttcaaaagttatgacgtttcagaactttattaccaagattataatggtcaatccatcaaacgggttgaataaatgcttagttaaacgtgtcttaaaatagaaaggaaacaccatgaacaataatcataattcacattatcaaaatcaaagaaattcgcatcaaggccgtccgcaacgtgaaactgtccaggaatccattccaatcggtcaacgaattcctttaaccatcaaacgcttaggcattaatggtgaagggattggctatttcaaacatactatttgttttgtgaagggcgctcttcctgacgaagtggttaccgccacagttaccgaaattcatccccgttacatgatcgcaaaactccacacgattcgccagaagagtcctaatcgtgtagaaccacgtgacccatttgctgatgaagtcggtggatttgagctagagcatttatcttatccagcccaattagagtttaagcaagatgttgtgcgtcaagctttggagaagtaccgaccatccggttataagtactacaaactgttacccacaattgggatggataacccctacgaataccgtaacaaggcccagttccaagtgcgtgttttggatggcaaagtagctgctggtttatataaagaaaacagtcatgacttagttgatttacctacgtgcagtgtccaacacccgttgacaatgaaagtcatgcgccgtgtcgttgaattgctggaagcttaccaagttcctatttatgatgaagaacatggttcaggtatcgttaaaacgattgtcgtccgggttgcggttgctactaatgaagttcaattagtctttattactaactccactaagttgccccacaaacgcgacttgattactgaacttcagaaacggtttccggaaattgtttcttacatgcaaaacgtcaacaagggaaaaacatcccttgtttggggtgatgacaccactttgttagccggtaaaacttttattcaggataagctagaagatctgaccttcaatttatctgcacgggctttttatcaattaaacccttatcaaaccgcaaaactgtatgatgaagctcgcaaagcacttgaactttcaccaaatgataacttagttgatgcctattctggtgtgggaacaattggcctgtctttagccgctcaggcaaaagaagttcgggggatggatattatcccggaatcaattgaagatgccaatgaaaacgccaaattaaacggcattaccaatgctaagtatcaagttggtaaagctgaagaagttttacctcaatggatggcagaaggcttccatcccgatgccctggtagttgatccaccaagaactggattagatgatgtcttgattcaaaccatcttgactagcaagccagaacgatttgtttacatttcatgcaatccatctacgttagcacgagatctggcgcaattaacaaaaacttacattgtcgattacattcaatcaattgatatgtttccacaaactgcccgttgtgaagcggttgtgaagttcacacgtcgacattaatttaaaagcataaaaagagttgcaataaacttgatataggcgtggtacagctatgtttctagtttgtctacctctaccattagtcaaggaaaacctttagttaataggttttcctttttttatcagcggttacttgaagttgaggttgtaattttattggcttaaatgttcgatttaatgtacaacaaatagtgcgtctggtattaataaatttttgagatgttagaatatcaataaatgaattaatcatttacttttctggtgagaatttcagtgaatcatataattcattatttttaattaggtggaaaatggtcctgatcaaacggtccattgctgctactgcaatcttcttagtgttgaattcactagaagattgcttttttcgttgataaagaatgctgatgtttgatggatggtacttggcaacagttaacatatttaaaacgactctaaatagtattttacgagcgtatgaattaccactttaccaaaataaaaaagtgatgaatcataatttcgtcgaattatgattcatcactaatgttagtcggcttttgtataaataattttagtcttgcgacgtcatttgacgttaattcgccgattggtggccgtttgaacacggcattggccgaaatttggtagagtttgtgtgtatcaacatatgatgctttgtacaaaccagcctttttccattcaaggatgggaaaataggtactttgaattgatcttgatttactaccaaattttgatgtaattttaaaagccgttacgtactgattattgtacgcaacgactagagcaggtctacgctttgtagtatttggctgctcatcaaatgacacatttgcaatgaaaatcttcatgactctagagatcagaatcatcttctttcatccatttgtcaaaatcaggacttttcttagggtcataatgtccattttcatcaatatcgacaacttcagttgggatgtttttgattagatctccccattctaagcgagtgggcagtttagtaatggttatgtcgccatcattagtttgcgtaaacgcaatttcatcaccagtagatagttgcattttattccgaatttcaactggaataacaacttgtccacggcttgatagtttagcagatttacttagtatattatccattatttaatgcctcctcatccttgaaattgtaagacgtcttacttcatacattatatcatgttctctcaattttgtttgtccgtcagcttaataatagacactttcataacattaacgtacctcagaagtgatcattgccttacacaccgttaaataaataaaaaactttgtctcacgtgttattgccagccacgaatgcgttaatgatttctgaataagaatcaattacgttcaattctctatccatgtttatacgtgcaaattaaaaatcgccgtatgactgaatggacattttaaagatggactgttaaagtggtattggtgcaagcatatatcatacggaaaaatcgacaagtttagttttttttggcattaatttgattttcttgtttgattgccataacgttgttgtctcaagttcggggcagtaattaacaccgcgacaagcttgttattgattatggcccaaacagcagtatttccgttataaattatattttcgtctttgagcatgatgattatttccatttctgttttttggtaaagcaacagatcccatggcaactcatgtttgagctaatgtaaatgcttatacaaagtttacttatactaatattttgatacccccatccagcgcagtatattgcatttgttgtactgtgaaaataactagctggggtaaaaccaataaaaacatgaagctacacgaaagttggtatatggaaaaataagtatcacttatgagggagcaaaaacaaaatgttaaaagtattaattacgattatagtaataattttaataataagtatcgtattatataattttatacgttctaataataaaaagtagtggtaaactgagccccgataatttggattattccaattgtcggggctcagtttatttcaactctttttttaacttatatttcgccaatctacagctgcctgtggccaatgtacattacgaatttgttcaagcataactgaatgtaattggtcttcagcatcggcaaaaataatcttttcatcgtgaaaaccagcaactttgccagtcatcgaactcaccatttcaccatcgtttatgagtttcagttggacatgaacaacctgtttatgtaaccatgcctgttttaaagactggctaactttttccaatgattgctctggaagttgtctttcagaaaccttatctcgtttcattttcttgatggcgctggtatgatctgaaaggaaaaagccgccccacttgagcattccgcgatcatgatagtcatttttaaaaaattgttcgataactgattcatctacccgtttgataatcataatctcatcccttactaattctggtctgtgcttgcggccaaactaattcgccaaagcctttaaactgcattgtgatctgtgtttgtttgcgcaacgaatgtactacagactctaagtagcctaaatcataattctctagcgtatgcagtggaatggatttttcgcgatgattttttggcttaacttccaaaaagaaattgtaagcttcatcaaaacgatccctcacaattaacatttgataaatagttcgtgattgccgcaaaaaatctttttctaatcgttccaaaattaactttgccgcctgatcgtatgtttcaatcaaaactattacccccattgtgaccgccaactaatgacgaacgttccagcatagtcgcaccatgcaataagctgctagctgggatcaacgccgtgttgccaaactggtcatgaattttatctaacactcgaatcattaaattttgcttgatttgcgcatgtggatctttaaataaatctagttgcaaaccgtcatttgctgacaaatgagaaagactgacggcaatattacgaatgccctcgccatcccatgtttttcgaaataaatacactaaatactggttaatctgatccggactatctgtcgtatcaattcgcatagaatgtgcaaaaccactgcgcccatcagtttccgcactagcataagaaaaaccaatcattaaactgacacatcctgtttgctgttgatgatgccgcattcgcgaggcaacctgactgccgatttctttaattaccgtttcaatttctctttgaaccaaataatcgcgagccaaaacttgggaatttccccaactcttatcattaggagtcaacagtttagataattggctatgatcaattccccatgcgagtgccaaaagttgtgtaccgatgataccaaactcttttttcaactcatagggatttgagtgggccaatgcatccatactgtgaataccaacgcgttcgagatgggctgctgtccgatgcccaatgctccagactgatactaaatccgtaatcggccaaatcttttgggggaaagtttcataagttaactcgccaatgcgatcattgtcatgtttagcaaacaaatctaatgccagctttgcttgaaccggattttcaccaatcccaacagttgtccataaacctaatttgtcatgaactgccgtttgcatccgatgagcgacttctagaggtgttcgtccgaataaccgccaagatttcgtcatgtctaaaattgattcgtcaatcgaataaggataacagtcttcatcagctacaaattgggtgaaaatttcattaatctgtaaattcttctttatgtaaagattcatccgcggtgggacaacctttaatcgggaatcatccggtaaatctcgacaacgcgaaacattggtgataccaaataattctttggctttaggcgatgccgccagaatcagaccaccattagtattttttgcttccgacatgaccacaataaccgattccaaaggatcatcctcgcgtgcgacagactcaacactggcataaaatgatttgttatcaatcataaaatacacaccatggggttctcgatcgtaattcatcgccatcacctctttgcatttcattatacgaacatacgttctaaaatgcaactcatttatttaaaagaattcaaaaaatatgatcgagaaaaatcgtatcttctcaatcctactttaatttttgttcagattaactgttgtgtctctcagcttttctacctttatagccgaaacgtgcttaaaaaggcagcttattccgctccatttgaagaccctacacattttgtttcgtcgaaactttgttcagttttcaaaggtctactatgtcgcagttggaagcgctaaacgcctcaacgcaactatttaactttatcatttcaaattctaaaagtcaacaaacttttttcaatacttaaaattaactttcctcgttcaaaacgaccttgaatataataccaagaaaactttacttggtcaagtccttttaaaaaatcaactcacaaaacttacagatcatctcaactaatcccataggttctcttagcggccgccttccattcaggtaggttgtcactaatacttctaaacccaatttcatcatcattacttgtccaataaaatttgtgataagcgtgtaccactgcaggaatcggcttattatgcatattatttttttgattcaacgcctttattgataaactcacatgttgatttgcaggatctatatccacaatcacgcaagaaaccacctgacctactttataaattgaagaaagactttcaatatactcgtcactacattcagaaatgtgaagcaaccctgtaaaagatatttttttattttcaacaaaaaggccgtatgcctggacccctgtaattgtaccttcaataacatcacccgttttaagcaaattcgcacctcccaaaattttatgtcaatattcattttagcgaaaccagaagtatgatacaatacttgtgcttttaaaaactttaaacactaataatataaagtacggaggaatactgtgtcttttctgattgattttgttttacacattgacgcgcacctaatttctattgtaaatacatttggtgattggacctatcttatcctgtttgccattatttttgttgaaaccggtgctgtaattttaccttttttacctggagattctctattgtttgcagccgctgcactttcagcaaatagtatgtatcatctaaatatttggatattcgtttttttacttttttttgcagcggtccttggtgattcaacgaatttttttatcggccgtgcagtcggtaatgcactcactgagcaccacatatttgggaaatttataaacaagcaaaaaatggcagaatctaaagaattcttcgatcactatggtagcatctctataactttcgcacgatatatgccaattattcgaacttttgctccttttgttgccggtggtagtaacttcagatatcaaaaattcatcatttttgatattctgggatcatcaacttgggtaagcttatgttgtggcgcaggatacttttttggaaactttcctgttgttaaacagcatttttccgtaattgttattggtatcatccttatctctcttattccaattcttgtttcctttctaaaaaccagaaaaaaagctgtctaaacaaaaataagctttattcgtcaccaaacgaataaggcttatttttttatctgtcttttccccaaccaaataaaaaacaggtaaaagatttctacaaacacaaagaataaaacaaaacactgtaaaaaaaactcctctggtaagacgttgataaccggatccttttgaggatcaaatatccaatcactattgcggaacaaaacctcatgaaaaatgacaaaaaattgatcaaatgagatgctcatcattgcaccaataaacaatggcacaacagccgtgacctgcaaaggccgaattaattgccacagcgttttggttttaacaagctcacgaataaaaaagaaaaaaacaatcgccgaaagaattaaaactccttcattcaacataaaaagacttttaacatccgaaaaatgttgtaatcccgtacttgagcttggaaaatcggtcatgtgtaagtgttcaatccatggaaaacttaaataggctatcagttgatgataattatgcatgatctctttgtgagataaacttaccgcagtttgaacgttataccattttaacgaccacgaatatagaaaagtacaattaataaccaaaaaaatggctaaagaaattccaaaaaaatgaaacccgatccactgtccaatccttcgcattcgcatagtaactacttccattcatcaaacgaattaattatgtgtgtaggctgaatttcttgctttgccacaaattctcgagttgaaaccccagtgtagaccaacaaagtgtcaataccaaaattaattccagcagaaatatcagtcatataattatcaccaaccatcacaacgtcatctttgtcaagaccaatcttcttaaccgctttttgcatgataattgtttctggtttcccaatatatgtagccctctgttgtgtagaacgttcaacaaagccaatcaatgaacccgctccaggcaccaaaccacgctcattgggtaagttggtatctgcattcgttccaataaaagttgcaccccgttttatggccaatgttgctaactcaaacttatggtaagtcacgtcataatccaagccgacaacaacccaatctggattcgtctcatcaaattcaaaatttctatttaataatgcctgctttaaaccgagttcaccaattacataaaccttgcgcttacccccagctataccatctaaataatctgctgttgccaaccccgctgtatagacttcatcagcagtaacattaatattgtgattttcgcgtaagttttttgcaacctcatcaggcaactgtgtcgtgttgttagtcacaaacaaaaaatccgtgtgtgtgtcctgtaatcgtttaataaaacgggccgcagcaggaatttggtctctgccccgataaatggtaccatctaaatcaattaaatatcctttataatctgaaatcatctaatcttcctcatcttgtctctcttattgtaaatgaacgtttaccacgtttatgaacttctgtaattttattcttccgttgattaaccggaactgccttttccttagtagttttctcctgtataaacggtttttctttgaacttacgaacacgtttattgtttcttttgcccttatgaggagattccttctttttttcgctaacagtcctagtttttaagctacgttttttagcaggcttgtttacactcaagttctttaaaataaagtaggcacaaccaaaattacaaaattctagcaaatagtcttgaatcgcgccttgcttttcattatccttagcgtttcgatcttgattgctgtaaaatcccttcaagcgcaactgttcataaccgatatcaccaacgataaagtcatatttgcttaaaactggactaaaccgttcagccaattgttcacgatcaaatgcgtcacgatcattgctaatcagctgatattgatgaccattaattaaaatgtttttattatccagtagatcaactgtgttgattactgggcgtcgcttcgattctacattctcagtatctttattttgagtagttgccattaaaacgcctcctttttatcctcgctttgcaaaatcttctctttttcctttgatcatttgttcaatgtcagcttctgaaaatggtgctccaaacggaattttatagtttaaataatctttttccggagtgtctataccaacattcaaattttctttaacattcacgctgtagtgatgaatatgtccatgtaaattaataatttgcttcacaatgcccatcatcattggataatgtgtcatatacaactgacgatgattcattttaatcaccacaccaacatcatgaaattcaaatttgggcttcccatttacttcaaaattacgtttctttaaatacttaaaaaaagcgcgactatcatgattacccttaattaagatcagattaccatttaaggcttttaacacgttgtaaactgcctcgtttgataaactagctggatgagtaaaatataaagcaatatcccccaagtgataaaccgtatccgttggttttacacgtgcattccaattatcaataattgtttgattcatcacctcaactgatggaaatggtcgtggtgcaaaagcattattacctaataaatctttatgaaaaaagtgtgtgtctgccgtgaaaaatttcaacttcatccctcattcttaattctctcgatatctagtatataacaccatagcgcattttatacagaattctttcttattttcatgactacttggttaaagatctgtaaatacttttatgtattcacatattgccatccttgaaatttgataaacaactcgttttatttttagatattaaaatttgcaaattaaaaaactgcggaattttttccacagcttcttacataaaataattattttgttccagaattctttttcatctgcactagataaatcaaattcaaaactacaaaccagaggacagacccaattaaagcaatcaacgtatctagtttcaacaccagtacaaaaccaacaaaaataagaaaagctaaaactagataatcactatatggataccaaggcatccgaaacttttcaggtttttgacttgtcttggataactgttgacgatattttaagtgggttaagacaatcgatccccagataaacaaaaaacaggttgtcgccacacttgaaacaaaagtaaaaacttggccaggcataaaaatatttaaaattactgctaaagcaatgactaaagcagacatcaaaattgcattagctggtacttgtgtccgcgataatttccccaatttctttgcaagtttcgacttacggttgtaactaagtgaaaacaacattctccctgttgtgaaaagagcactattgcaagcggaggcagctgctgtgagaaccacaaaattaataattgcggctgctcctgtaattccgacattttgaaagacttgcacaaacgggcttgatgttggtgaaacatatttccatggaaaaattgccataagaaagaacaacgcaccaacataaaacaatccgattctcattggaatatcattaattgcctctggaataacattattaggatcctgagtctctgcagcagtcatacctaccatttcgacaccaacgaaagcaaaaaccaccatctggaaagaaagaacaaatccctttagcccctttggaaaaattccgccaaaagccactaaattcgttaatgaggcatgtccaactgaggtcttataatgaattaatacaagcacaattcctgttatgataaggactaaaattgctgttattttgattattgagaaccagaattcggtttctccaaaaagctcaaccgtaattaagttcatagccagtaaaactaacaaaatcacaaatcctggtatccactgcggtaaactaggaaaccaaaaatgcatataaagtcctgcagctgtgatttcagccatcgcaatggtgacccagcatacccaataggtccagcccgtcacaaatccgacctgtttacccaaatattttgccacaaagtcaacaaacgaagtggaatgcaaatcagatagtaacaactctcctaaggctctcatcaaccaaaaacagatcactcctgtgattgcataagcaagcaaaattgatggaccggccagatggatggattgcccggctcctaaaaacagcccggttccaattgtccccccaatggcaattaattggacgtgcctactttttaaacctctcgataaattttgatcttcattttcactcatatttcctccatacatgcttcaatgtaatagaattacactcaatcatataggatttttggaattaagtaaaattttgattagaaattttgttgatgccactgtctaatctcagccaagaactttttcattcttgtttgatccttaaaggatggagaatccccaagcatcacctttgaggcctgttttgcaccattaccctgattttgtaaaattaaaattgatttttgtaaattaccattggtgaacatgtctttaggcaaatttaaaaaaccttgtaaaaatattttgtttttaaaataattcaataacttgcctgcctgatcagtttgaaaaatattactaggcaccaaaaacagtccaaaaccaccatccacgacatgattcattgcttgttcaatcaataaatggtgcacaaaggaatgaccgctgtcactatgggtctcatagtctttaacacgatgatcaatgggataatagccgaccggtaaatcggacacagcaaaattggctgcattaaaaactaattgatctaatgcgtcctgatgataaagattaactgccacctgttgtaactgcgtactaattccagccagtgctaacatagagtcatcattatcaattccaatcccagtaatttgttggtctttatgattatgatgaatatcattcattactgttgtgagtaaattagcggtaccgaccgcaggatcaagaatctgaatgtcgtcttcgccatcctgcagttcttgcaaaagataggcaaataacatcccgattgtatcaggtgtcatttgatgatttgcctgaatatgatctttttgagccgctttcaaaatggccagctgtaatgcttgccgaatggactcattatctaattggctcaaattcacttcggcatagaaatgttccaaattacgcttaacctcttttgttggccgcccatcttctacttgaacctgaccagaaattagattatttcccgtctcgattaaagcatctaagtaggaggtatccagctcagctacaagtgtttccgtactctcatcaattattttaaatagttgttctacttcattattcgtaatcattcacctcgtctaaacttaaactcctcaaatatcttaacacgaaataaagatattgggcatttatagcggctgatcacttgcagtgaacttgtaacaatgttgattttttaaagttacaataaattttttattcaaaacttccacatcgccaatatctgattttaggcctttatacttagaatcatcttttcgtcgcaaaattaaaatattacaaagaacacgagcatcattcatttcaactacttttgcctgagaagcaatatttgcttgttgatgttgttcaatttgaaaaacaagaccgctcaaaatagccaaaaaaatgatggcactcaataacacataacctgatttattcttttggaatatagacatcatcactttttgcctctccatcatcaaatttaatttgaagtttcaagaatggttcttgataatcaaaatccacagaatttacatgagaaatcaacggcatataacctggtgaaaaccgcaattgatcttgatatttttctaacttataaactttattttcttcaagactagttaggtttacgtaagaatggctgctacttttcaaccgaaattgatgtttagatgattccaattcgttcaccagaatttgccaatcagctgaattgttttgttgtttaattggaatattgattaatttagtgctgaaagaaataaggtggaaaatgattgttaatattaataacgatatgagtgtttccatcaatgtaaatccagattttttattcaatttctattttccttaaaacaccctgattttgatcacttaacgttatcgagcttttcgtaaatataaacttgctatctggtaaagaaaccgactgtgatttgtttgctttcaaacaccgacttccatccagcagtttgcgactaattgtaacttgtttatttaaccgcatctccgtttttcgctcattttgaacacaactgtggattaatattaacgaaatgcttaccagacccaaagcaaccaacgcctcacttaaaataaaaccttttttattctttgctaacatgatagactccccaacctaattgaatcctcaaacgatacgtgcatttatttgcttcagattgaaagccaatcgtctgaggcttgacatacccattactaccaatttttacctcttgattagtaaacagacttaaagttttaggtaattcaatctcactattctctttttcaaaagctttaagtggcgtaaattttacttttcttcgagttttatcaaacgaaatatacgtgaccaccccttcgaaattagcaaattgttcatattttttccaatcatcatcaaattttgcccagaattgtttttcttgctgttgagccatcactctttttaaagtaaaatgaccaatcgaaagtaaaagtgtcacaatcgttaacaccaccaaagtttcaaccaaagtaaacccattttttattttgcacattcttcactacttcacagctttattgtctttaatggaaatgtgattttcttcggcctgacttacttgtttttcagttaaataaccgccttcttccagttcatcaagtgaagttggtaatttttgatgctcattttcatacaaatcaatttgagtttgcacaacctccaccattgcatttccatggattgtttttgcattgcttctctgttgtgcaatatttggtaacacaattaatattaagagagaaatgatgaaaagaactaccgtcatttcaatcaaagtaaaaccagatttattttttcgtaattttttcatttgtatactccctccattgagtggtacatcggtaataacaagcttaaatacataaacacaatcacaaccccaattaaaagaaacatcatgggctgaattaaaccaatcaatctttcaatttgtttggttaatttttgatacttaattttcgaaaacatcactaattcttttcctaaagcctcggtcgtatttcccttgttgagcatcacgtttaactcttgtgggataaacggatagcgattaataaataaacgagtttgctcaccttctaaaagctgtttctccaaagccttgccaatttgatgcagtaaagatgtcttcgagaaattctctaacatattacaaatactttttatacccaacccactttttaacaacattgctaaattgagagaaaggtaataatgacaataactttgataaactttcccaacaattgggatccgacaaattacttccaccctctgcacaactggctgttgccaaaactttttggccatgaggaaaaccaaggtgataatccccaccataattaatagaatgatcacagtagaatttttaataacatgtacccgtgtcgccgtattccacatgtttagttcaggaaaaatgtaaatcttcatgcccaccatcaacatccctaaaaacagcaatagtagaatcggatattctaacatctgcaacaacttagattgatgatcatgttttgtgtctaaataagatcctaacgttttcaaactctcagccaattcaccatgtttttcagcaatcaaaatttgatagtaaatatcctcttttaaaaatggctttattgcatccgaaaatgcccctcccttttcaagtaactgaatcatttttgatatttgtcgctttttggttggaattacaatcttgataaaatttaaggattctcgcaaactaaatccaaccgccaataaatctgacaatagggtaaaaaatctagcttgaactttagtggaaaacttatccttcttgatattcaaccaaggtttcttcagaaattcgacttttttgatactctcttgcaagacaattcccccaatttgccgtcattttattttcaggtatttcccgaaaagctgtctggagctgctttccctgcataatatcaaacagtgctgcgacttcatcatcttttgtagggattaaacgttgataagcaacgccacacaaggcttgttgaagcatctctggatcaacgtcaaactgttttaatcgcctaatgaccccaaatacattttgcgcatggaccgtacttaaaactaaatgaccacttaaagccgctttaacggcaacattagcagtatgattatcccgaatttcaccaataatgaaaatatccggacgatgtcttaaccctacttttaataattgctcatagttcatcttggctcttgtattaacctgcaactgtaaaaagtccttctcaaaaatttctaccggatcttcaatggtcatcaccactttttctttggccaaatatctggcaagtcggtaaatggaagtcgtcttacccgatcccattggacccgaaaacaataaaagtccccttttattagtcagttcaatcaattcatgccactgtggcggatctaagtgttgaatatgcgcctctgaaattggataaatgaaccgaataactaatgattcacggttgagaaaatcacccaccgttgacaatcttagatgaaccactttgccgtcttcttgatgccaataataagcacctgtctgtggtcgtcgtttttcactgagggccatatctgcttgaaacttaaaaaatgcgattaattgttcacccacttgttgcggcacttcttgtatcaaatgacaccgatttaattttttatacatcacctgatagtcatctaatttaggcaaaagatacaagtcagtcgcccgatttttgacacaggttgacataaatttttctacataatcttctaatttcattttcctacctcccccacaaagataagatacgtaaaaaaacgaaatatatttatttaaacacaaaaaaaatcaagttcttaacgaacttgatttaatacttgtctatttaattactcttctggcatttctgcagcttcataaacttcagaaacatcatcattatcttccaattcatcaatcaaaccttgatattggctaattttatcttctggtactggcgtttcattttcaggaatcatggttaactcagctgttgccaacttataaccagctttttccaatgcatcacgaacttcggccaatgccttaggatctgtatagatttcaaaagcatcatcagaagtctgaatgtcatcggcaccagcatccaaagcatccatcatcatagtatcttcgtcagtgtcatcgtcttcccgagaaatgacaatataacccttccgatcaaacatgtatgatactgaaccgcttgcacctaatgcaccgccatgatgcgtaaatgctgaacgaatagcagctgcagttcggttcttattatcagttaatgcttcgacgataattgcagtaccaccagggccatatccctcataattgatttcttcgtatgctgcaccaccaacaccagaacctttatcgacagcacgtttaatgttgtccttaggcatgtttgcggcacgtgccttatccatcatcagacgtaactgagggttaccagaagggtcaggacccccagctttgactgccatataaatttcacgtgaaattctttggaagatctttccacgtttagcatcctgagcgtttttacgaccctgaatattgtgccatttagaatgtcctgacatttccaaactcctcttttctatataatgaatttttattgttagtaaaaccttatctagtatagtaaataacggtgtttttggcaagtgtttcaaattgactcattaaagagacttatctatattttaaataccgctgtttaaaacccctttaaacatcagtcattttcatgcacacgctatcatttctatctaaaaacactgtaaaagcaaaaaagaattcgcagttggaattctttcattctgtttctattaaaaggcaactttaattgcctgtttcaaatcaccaatcaaatcatcaacgtcttcaaggccaattgataaccgtaaaacttggtcatttagaccctgagattcacgaatttccgctggcacctctcgatgcgttgtccgcgtaggattcacaattaatgatcgtgaatcaccaatgtttggtaaataactaaaaacacgcacattatcaattaaagttgcgacattttttgaatttccttttaattcaaacgataagatgccaccaacacccttgggaaaatattttttgactaacggatttcctttttcaatacctgaataaaaaacttttttgacatgttcgttttccgttaagaactgagcaatttttgtggcactcgccacttcccgatctaaacgttctgagatcgtttcaaggcccaataagattaagtaggcatcaaccggttctaatactgctccaagcaatcgcaaatatttcatccgaattcgacgaataaaggcttgtttgccaaatttgctgacaaaactttcctgcgtatgcaagtcttcatcccctaatgtgaattccgtttcactaaattgagggaacttgggactatcccaatcgaacgtaccatgatccaccactaaacccgaaatcacatttccgtgaccattgattcctttggtagatgagtatactgtgatgtcagcgccatgttcaaagggtctcaacagatagggggttggaaaagtattatccacaatcaacggaatttttgccgcgtgtgcaatctcggctaatttttctaaatcagcaatctccgtactggggttagctacactttcaacatagattgctttagtatctttctcaattaaactttgaacggcttgaaaatcattgatatcatccacaaaatcaaaattgatcccaaattttgggaaaaatgtgcgaaattcatcaagactagaaccatatatattacgtggcgcaataatgcgacccccattttcggccacgtttaaaatggtatatgaaatagctgccattcctgaaccaacagccacagcatctatcccaccatctaacgctgcaatacgttcttcaaacacgcgaacagttggattgccatcccgcgaataatcataccgaccagcgagtttaccagttacaattttatcagccatagctgtattttcgaggccaaacgccgctgtttgataaattggcactgacgatgcaaaacgatggtctttaggatcatatccagcgtgaatcctaagtgtatcaaatttattttctgtcattatttcatcctcctactatgcgtttctttcattactttgatttaacccactgggcttaacagccacctcgatggcttgttgtaaatctgcgattaaatcttgactgtcttcgatgccgaccgcgagtctaatgagctggggactgattcccgccttcaatcgttctgctggtggtaactccgcgtgactcatttcgtacggtaattctgccaaactttcaactgctcctaaactaactgctaatcggattaaccgaagatggttgacaaacgcaattgcatccacgttttcaccaagctcgaaggacaaaacaccaccaaatccatttaattcatccgaagcaattaaataatcttttgtacctttaataccgggataataaatttttgtcacttctggacgtttttcaagaaaattaataatctcaaacgcattttgttgttgtcgatccattcggactgataatgtttgaatgcctcgtcgaatgagattggcactttctggcgaaagaacgccgccaagcgcattttggataaagtaaatttgcttgcctaacgtttcactatttgtcactacaagaccagcaatcacatctgaatgtccacctaaatatttggttgcggaatgcacaacaatatcagcacctaaagttaacggtttttgtaaataaggtgttaaaaaggtgttgtcaacgatcgtcaataagtgatgctgttttgcaatttttgccaccgattttacactagatacatgcaaaagtggattggtaatcggctcaaagtatatggcttttgtattagtttgaatggcgggttcaatcgtttctaatttggtggtgtccacaactgaaaaactaattccgcgctctttaaaatactgatttaaaattcgatacgtaccaccataaatttgattgccaactaaaatgtgatctcccggtttaaaaatggccaaagcagcatgaatcgcagccatcccagatgcaaatgcaaaaccattctttccttcctctaaccgtgtcatctgtttctccaagtattcacgagtcggattaccggaacgttcataatcccaacgtaccttactagtcgcacttggataagcataggtcgacgaattataaattgggatattaacagcccctgtctgattatcttgaattgtttcaccgtgaaccaaatttgtattaaagcctgtcattttaaaattcctccaatcaaaaaagcacacatccatcctcatctatttctagattaaggacggaaatgtgctttttcccgcggtacaacctttatttgagcatttctcacgaactactcctcatcaggtacaatcaaaattataccctaactcaataacgggagttcccgcgctagccttacaatcttgctcgaccaacgaatttgaaattagaccatcttccatcggcttctgccatcgttttccaccacacaacgactctctaaacccatcaactgatttactgatctattcgtttttataatattaagtattatcctaacgctatcttttcaaaagtcaatctttttttaaccttttctcatcaaattcttatttaagcaatttaaatgctttttatatactgagtatcacaggctagatgttcatccccggctaacggtttagccagctttgtaaatcccgcatgttgatataaaatatttgccactgccaattttgtatctgtaactacatacattttttggtagctttcctgcgcaaacgtaattgatttttgtaaaaggattttggcgagcccatgcccacgagcctctggttttaaatatagtttttgcaattcacaaacttctggctgaccgggtaccggacccacaccacagcctccgacaacttctttattggtatcatcaatgactacccaatagatgccatgaggtagtttttcatagtattcggccagtgaatctagttgcggatcaaaataggcggttccaggtatattaagttgcacatcacgtaaacaatcttgaataattttttttattgcttgattatcacttggttgaattttacgaatctttagcatcttggtcacttcaatctaaatagaattaaaaataagcataacccaatatttttgcttgtcaatatgtgaacaaggttcattcaaacttaattattgtaacaatctaataaaactagccattttggcacaactgtctcagtttttcttcggtgacttgatccgctgcactctgaataaccagaaaatgagtttttgtagacgaaattaaagttgtttcggtaaggtataactcgcccactcgcggctttttaagtaacagacgtaacgtttgcatgtctagtacatcgagctgctcccaaggttgagagaatccaggttcatccctaatcatttcgtagattttatacaaatatgatgaattgggattttcactatagagttgtcgaaattgagcaactcttttagctgcatattcattccaatcactaaacaaatctcgcaaaacaggattcttaaatgtctgccaaagaagatttcgttgaatttttgacttgctatccagctttccatatagttccacaaatgcacgattcgttttttgaatgataaagttgcgatccataataaatgctggatacggattttgaaaatttaataaccttacaaaatcaccgctaatatccgggatatggttcaattcgggaggtaactttttttcaaccaaattaaatacatagttaatttcagcgtcatttaatcgcaaaacttcacacaatgcctctaaaacttcaactgatggatttacgcccgttcttccttgttcaattctacgtaccaatccgtacttaaatttgctctttcggccacctcttcgcgagtaagtccacttgcccgtcgatgcgtatcttgaacaattccataatctttcaaattagctgtacttcgtttatatcgaaaaaaatgtcccaaaggtttttcattcatttgtatcttttcctttcacttactaagtaccaaccgttatacgcaattttaaaaaatctgccaaactgggatcatcaatcctaggataattgagctcttcctctgttttaaatatcccgttatgataaaaatgttcaaaatattataacattcttaggaggtcattttatgacagttaaaattggaatcaatggatttggcagaattggaagattagctttcagaaggattctagaactacaagatgatagtaccatagaagtcgtcgcaatcaatgatttaacgagccctcaaatgttagctcatttgctcaaatacgactctacacatggcaccttgcaggccgaagtcaatgccacacaggacgcgctgattgtggacggcaagtcctatcatgtctattcacaaactgatgcggccaaaattccttgggtgaaaaatgatgatgtggattttgttttagagtgcacagggttttatacaagtttaaaaaaagctcaagcgcatttacgcgcaggagttaaacgggttttaatttctgcgcctgctggtacagacataaaaacaattgtttatcgtacaaatgacaacattttaaactctaatgatcaaattatttctgctggttcttgtaccaccaactgtttagcacccatggccgatgcgctagataaagaatttggcgtagtcgctggcacgatgacaacggtccatgcctatacctcaactcaaatgttgttagatggtcctgttcgcggtggcaatctacgagcagcacgggcagccgccaaaaacacaattccacattcttcgggagctgctatggcaatcggattagttttgccccatcttaatggcagacttcaaggacacgcccaacgagttccagtgaccgatggttcgttaaccgaacttgtgactatccttaaaatctctcacttaacagttgatgaaattaatgaacgcatcaagccctatacaaaaaataatgagagctttggttggaataaagatcaaattgtatccagtgatgtaattaacacaacatttggttcaatatttgatcccactcaaaccgaagttgtttctgcagacaattcacagctggtcaaaaccgttgcttggtatgacaatgaatatggatttacctgccaaatggttcgcactttgttaaaacttgcacagtttgacaactaattttttcaaaacagttaaaataggctaatcaaatgtacataccattgattagcctattttgtttagaaatgttcaaaattcaaaattatttttttgtcgtttcgcgactatccaagccataaggtaacgtaatggttggttcttcaatttcttctttgttcatcaactttgtcaataaccgcattgaaactgcaccaatatcataaagcggttgagtaatagaagttaattgtggacgaactaactgcgcaacttgagtatcgttacttgtgatcaacgcaaattgatctggcactttaaccccctggtcagttaaaccatttaaaacccctgctgccaaacggtcatcaccagcaaaagcagctgtaatatctgtgtccttaagttggctagctaatttaattcctgattcataactatagtcagtttcaaaaattaatttctcatcaaacttaatgccagcttctttcaaagcttgcttgtatcctgccaaacgatattttccattaattggttcacttaacgaaccactgataaacgcgacttttttgttaccttctttaatcaattttgatattgcttcagcagttgattcgatgtaatcaatacttacagaaggtacactttcttcatcatcaacagatcctgcaaaaacaatcggtgttcttgaatgagaaaattcttcccgaagtttgtcagtaacccgattacccatgaaaataatgccatctacttgtttagcaagcaatgtatttagtactgccatttccttttgatcattttcatcggagttttccatgataatattatatttatacatagaagccacatcatcaattccacgtgctaaagaagcaaaataggcattcgttacatcggggatgataacaccaattgtggttgattttttgcttgctagtcctcgagcaacggcatttggtcgataatccaatttgtcaatcacatcattaacccgctgtcttgtagcaggctttacattttggttgccattcactactcgcgatacagtcgccattgaaactcctgcttcacgcgcaacatcataaatcgttacagtttgtttttccatttttaactcaggtctccttttatgcgttactatacgttttcataaattttcactgtattgttaacggtatcaaaaaacgcttaactgtgcaagtgtggaaaacgctttcatgaaaaatatacctcttttttagttatatttcaagactaaaccgatatgatataatgttcacaactaaaaagaaagaagacgattacatgacacagttggataaagtccgtaaatgggtcagcaaaaatgaagttgacgtagcttatattagtgaccccaaatcaatcgaataccttactggttttgccagtgacccagtcgaacgaattcttggattatttgtttttgcaaacaaagatccctttttatttgctcccgcactagaagttgaagcaattcacgatacaggatgggagtttccagtttatggctatttagaccatgaacagccgtttgagatgattgccactcaaattaagaaacgtgtcaaccaccctgttcagtgggcaattgaaaaaaacaatttaaccattgatcattataacgccattaaaaatcagtttttatttgctaatttcgaaaaagacttaactccttttattcaaaaattacggttaattaagacggccgatgaaattgaaaaacttgatgccgctggtcgcgaagcagacctggctttcaaaattggctttgaagccgtccaagccggacgaaccgaagctgaaattgccgcagaattagaatacgtgcttaagaaaaaaggcgtcatgcaaatgagttttgataccctcatccaggctggcgctcatgcagccgaacctcacggtgcaacaggcatgaataaaattaaaaataacgaacttgttctatttgatttaggtaccattcaccaaggctacatcagcgactcctcaagaacagttgctgtcggtcaaccaagtgataaggctttggatatttataaagtttgtttagatgctcagttaactgctcaatctcaggctaaacctggtatgattgcagaagatttagataagattgcccgtgacatcatcacaaaagccggctatggagattactttattcatcgccttggtcatggaatgggaatgggtgaacacgaatttccttcaatcatggagggcaataagatgtctcttgaagaaggaatgtgtttttcaattgaacccggtatttatattcccggcgttgctggtgttcgtattgaggattgtgtacacattaccaaaaatggttgtgaaccatttacccatacttcaaaagaactcacttatgttggctaattgtaaaaaaataaggtctcctgcaatttgcaggaggcctttttgattatccgaagttagtcaacttttggtttttcatcatgtgtatgtggcataaaaacttcagttggttcatcgtaactatctgtgccatcaacaaagacgtcattttcttcatctaattcatcttttaattcatcagtagatgcttgaaaactgtcctgagcagcacctaaaaactcgtcttttccttcaagaaccttatttttcagttcaaccgctgaatcaaaaacacggtctttcaactcgtcttcccaatcagcaccctctaaatcattttgttctctaaatcgattgactttattttgtgctgcttgaattaattcttctttggttgtgcctgttaattttaatgtgccatacacagcggccgcgccaccaattaacgcgcctaataaaaatttaccttttgccattataaaatcctcctagtctttcgtttgtttatttttatgttcacgatacatatgaactgcacccttaccagccttcaacgcagtcgaaacagttcctgcttttttacctggacttgtaagtttggtagtcaaattacgggttgcttcatttaagtctgaagtactctggcctaaatcagccatcgcttgaaatactggatcaatagtggctactttgccatttacatcttccaataaatcgttggcgtttgccataatatcttcagcttctttagaaagtaaatcaacatccttagttactacggcaagacttcgattgatttccaccaaagtttttgatcctcgtaccaatacaagcccgataaatagtactaaaatcagtaaagctactgctgcaatgattgctgcgattccgccacctgtcataatttatcctcctgttaacttaattgtcttaagcatatcattagagattaagcactgcaattaaaaaagaagtaaaatattttttatgaaactgattacaaagaaaacctagtctgttaaaatcaatatacaaggagatgagcatcattcactttctaattggcgttactaattcgcccagttccctaattaaggcttttcaaaactactttacggcgtttaattggcaaaaacttgccgaatcgttaatcaaccacattcttgaaattatcctaatttctattttcttttggctggtcaactttattggtaaacggctgttgaccaacggtttgcataagtatcaccatttaaacgacgccattccaagtcgagctgtaaccttactggcattggtagttaacattttccattatgtcgttttattcttttatctctacaccctactttcaattattggtgttccggtaggtacactagttgctggagcaggaatcatcagtatcgctgttggtcttggtgcacaaggattggtaagtgacattgtgaacggcctattcattcttcttgatggccaattagatgttggtgatcaagttaccattcaaaatatcaatggaaaagtaactgaaataggtttgcggtccactcaagtcctttctgacgatgggacaacaaactacatccccaaccggtccatcacggccattgccaaccattctcgcaatgatcaagtggtttccatttttttggcctttgaaagtttgaccgatttagcctctgccaaagatcttgtcacaaaaacaacttctgaattggccaacaaactaaatgaagtcaccactgatcctactgtaactagtccgatccaagatgtaaatggcaacatcggtttacgcgttaaaatgtatgtcgaaaacggcactgttgatcaaattcaaagaacttttctccaaaattatctaacaatcttgactgagaacaaactaaggattattaataaccaactattacaaactaaaaaataataaagtttgtaactgaataagagcccgagaaaacgaacttttccccgactcttatttattttgctcctcgtttaccaccattcatcaaaaactttgaggagtttttgactagctcgtccccgatggctaatttcgtttttctcttctgaggtcatttcggccaaagatttttgtttttctggtacccaaaataacggatcatatccaaatccattattgccacgcggaacagccaagatttggcctctaagttccccattaaccactaacttactttcatcaggtttcatcaacactaatgtcgtatgaaaagttgccgtccttttttctaacggaatcccagctaactcacttaacaatttagcattatttgccgcgtcgtcgtgatcgcccgcataacgtgcggaaaagattcctggacggccattcaaagcgtccacttctaatccagaatcatctgccaaaactggtatattggtctgtttagaaactgcagaagcctttaaagtcgcattttcttcaaaagtcatcccagtttccgcaatttttccgagttgtggatagtcctttaacgaagtgaccttaatatgttttggagcaaataatttttgaaactcacacagtttcccagcattattagttgcaataataatttgttctttctgagccattacttgtcctccaaacttaaccggtcaatttctgttttatcagctttaacattaatctccaaccactgactagcaatctgattgaaactttttggcgatgccgttgtatagtagtgatcttcaatctgatcacctgctgaatcttttgcgatatcaaaataatccaataatgcagatacggtgccaattgtttcagcacccgaatcaatcagtcgaacctgaggacccatcacatcttggataataggcctcagtagtggatagtgtgtacatcccaaaacaagggtatccacatccttattgtcgaaatactgtaaagtttctgccacaacttttttggcaattgatgaatcatattcgttactttcaactaaaggtacaaatttaggacaagctaaactgaaaacttcaaccgaattatccttagataaaattgctcgttcatatgccccacttttaatcgtgccttctgtcccaatgacaccaatacgacgattgcgcgatacttttaaggcggcccgacttcccggtgaaattactccaataactggaatgggcaacttttctttcaagtcttctagagccgctgaagttgccgtattacaagcaataactaacattttgatattctttttcatcaaaaatgcagccatttgctcagaaaaatgccgtacttcatggcttgaacgcgggccatatgggagcctagcctgatccccaataaagtagacagattcaagaggcaactgtcgaagtgcttcacgcacaacagtcaaaccacccacaccagaatccataaatccgattgcacgattatccatttcttttcatcctcttcacgtaatctgaaactatattatctctttttaaaaactgaaaagcaagtttcctcatctaaaaaaagcaaagcaactagattagttgccttgcttttctaatagtctcctgccataaaaacaattatttttttatacttatttgatgttgccatgccgttgaatagaacttactattcatttggtaatgaggtgttttttgcttttttgtcaagaacggatcaattgactggtcagcagccaaccaaccacgccaacctaaatggatggtatcttgcataaaatacggcacatttcctttatcacttaaatcacaaatattgttgaacccttgtgattgcagttgatatcgaatttttcgatcaaattccttgagcattgtttgcgataacccagtgtatgcactccacttttgattaacgggtggaataataaactcaacattcatgtttaaagaagcgaattgattcaaaactagttcgaaatcgctaaactcaggcgattgcacataactccaattttgttcaaaattcttaaatttctttgccttgtcgtgtaatcgccgaacataaaaccgattatcgatgccaaatcgattatttgtcgtatgctgctttccttgcgcaacagctaactgatctaaatcttttaattgataatgatcgggtaactgctttgcaatccgatcaattttaccctgattatttttcattttcaaatcagaaaaaagttgatcttcatgttgcaacaatctcatctcataaactaaataagttcgttcgtgtttcgtaatttgtttgccatcagcaacacgctttagcgccatcataatggtgtgattggcttttccagagggcatattcagcaatcgtttggcagcatagcgatcttcggcactgctagcttttcggctcaagagccaagttgccgattgcatcggtgaatagtaaaatccgaaagcatctttgcgggcgccctttttgacaaaccactgtggtgaaatcacaaaaacggccttacgattctttaattgtgacgtaactaattgcatctgaaaataatgagtaagtgactgagttccaggcccacccatcaaaaacggagtgtaccttcgttgatactttgtagccaatacagacggatgcgccatgtcgaatctggaaaattctgaggatccaaagaatggcacaaattgtttgtgtgatagggctgattctttaattatttggcctttaagcacatttggagacaaagcaactgccgctttatcttcagttttagttgacatatgattcattttaaatggggaaaacaatagtgcaatcaacaataatgcagccaaaagaaccggaccaaatatcagaaaaagtttttttgccactagttctgcatttcctcagcattcgcaataattttattgggcgtatcccattcactacgctcaaactcagacactggtacttcaattcctagctcactttgtaattgtaaaagtaactgaacggtacccattgaatctagcaatcccgaatcaaacaaattattatctaaatccccgctcaaatctgtgcctgttaaatcttgtaaaacgtttaaaactgtttcttttgtatccattttatttactcccctttaaaactaatttacttcgctatcaacattgtattcaaaaaacctgaaaacagtaaaaatgtaaaacatacaaaattaaatgtgacgaaagttgcaaaaacttccgtaaatttattatgcggtattttccccggatgacccttcttatatctaagccaccaatcgttcacaacgagcgcgaccccgtgtaaaatgccataagtaatgtaataccacgtcaccccatgccagaaacccataatcgtcatattgataatataggtgacattagccgttgttttagggcttttaaaaactttgtgtttcatgaaaaagaaaaccaaacgcatataaatgtaatctcggaaccagaaagatagggtcatgtgccatcgattccaaaattccttgatattatgcgatttgaatggtgcattaaaattaattggtgtttcaattcccataaaatagctggttccaattgcaaataaactataacccgcaaaatcaaagaaaagatacatgctgtatacatacatgacaccaactagtgaccaggataagccatgcgccatcagagcgtagtgctccaattttggcaaccacattgtgccaaaaacataagccaacatatatttgtatacaaatcccataaatatattgtgtaaccctttttgtagtaactggaaatatttctcttgttttggcacatgatcataatcccgcttaaatctccggtaacgatcaatgggacctgatgagattgttggaaagaaaaccaagaattgtaagaaaaaccagggactaaagtctttcaaaacaccatcacgagactccataattgtctgaactgctttaaaagttaaataacttattcctaagaaaccaataatggcttgtttgccttcttgaattgccggagttaatttgacaatcacaagcgggatgattgccaaaataacagtcgccacaaatatccccgtttgattgtttttcttgcgataactggtatatacccatactaacaacacttcataaactaaatacgtaattaaggccaatccctgtgtaatttttggaccaccaaaagtcagaaccaaaaagaaaacagaaatcagtgtctcataccagtgaaatctttttccgcataaaattccaatcacaatcggcaacagcgcaagacctaaaataccaaaatacatggggttttcatatggtgtaaatgataacattaagaattaacctcactcataatggatttgatgtcaactttaccgttcgccgtcagcggtaatttgtctttgaaaacaaatcgatttggcaccatgtaaggcatcatcgttttttgaagatcctttttaattgccatggtcagggccatgtttgtttcttcaaggctttttttctgaagagtcacataggccaccagttgtgaaactttatgatttaaatcatattttggaactgccactgcttgtttgattaacttttgtgcgttcaagaaatggttgacttcctctagttcgatccgatagccatggagtttgatttgaaaatctaagcgtcccagataacgaatcattcctgacttatccttttttcccagatcaccagaatgataggtgttcaaatttccttcacagtgaaaggcattaactgttttacgcggattattcaaatatcccttagaaactcccggaccagaaatcacaatttccccttcttcaccgtttggtaaaacttttccattggaactcataatttcaattttcgtatctaccttggcttgaccaattggtaaccggtcataattggtcaaaatctttggcgtaatttggactgctgtaactgccacggttgtttctgtgggcccatacgtattaaagacgcgagcctctgggaaacgttgatttaactgtgcggctgttttatgcgtaagttcctcaccgcaaaacaaaaagtggcttaaatcaggtaaatgcttggcatcaaacgaaggttccaataaacaaatatctacaaatgatggcgtggatacccatacattcaacttcatttttggtaaataactgaaaagccgtttaaaatcatctgtgatcttcttaggtaatactttaagagtaccgccactgacaagtgttggatataaactcatcaccgacaaatcaaatgagtaaggcgcttgagccaaaaaagcaggtttattttgtaagttgaaatcacttaacatccagtttacaaaactaagcagattttgatgactaatttggaccccttttggttttcctgtcgtcccagatgtaaaaataatgtaaaagttttgattaccgacaacaggcgtccaagtttcttttaattcggttcttctaaatatttgagctagtttttctgatctaattaccggaattttattaatttcaattggcagctgttcaattgcaatacaagctgctggcttcgcaatttcttgaatcatagtcaaccgatcatttggtgagtgttcgtcaattggaatataggcatgcccacttttaacacatcctaaaaaactagcaatcatttcaaaagtctgttcgccataaaccatgattggtgcctgtggttctaatttcatttgagcgatttgatttgccaacgcatccgaataactcttcagctcttggtatgtatgcgtttctcccaaataatcataagcgacgcgatccggtgctgtttgagctacctgatcaattgcttgaatcacattggtaattttcatgttaatccccccgtaacttaaaactcattgtagataaatgtgcccccctgaataccactgtaaccatataggtaaacaagaattaaaaaaacgacaaaataaaaaaacatctgcccaagaaatttcacccattcccgctgccataatgttttaaaaaagtttttcacgttatcccccctgaatacacgtttttcctttcacagtatctcatgaattactggacctgtaaatatgtttcagtataatcacttaatcctcctgtaacaatctattaacgcaactgttaactaattctttacttcgcttaaaaaaggcttaaaaaaaaagatcaaaacgactcctgaaaaagtcgttttgatctttttttctctcatacttcaattatgcgtactgtgctaaaaccttttggatttgttcttttgagtggtaaccaaccaacgtatcaacaacggcgccatcttttttgaccattaaagttggaatactcataatgccaaagttttgtgctgtctttggattagcatccacatccattttggtgaatgtaacttgatcattcatttcaccctcgagttgttcaacaacaggagactgcatccgacaaggaccacaccatgttgcccaaaaatcagttaatgtgacaccttcgctggttttgtcattaaagttatcatctgtaattgcttctaccatctcaattagccctctttctgatttactatcaatagtttatcaaagattagattaaacaccaaaaattttgcttacaaaaaatcagttatttgaaatgaacgaccgtggcgccgtttcctccagcattcggtgctgcatattcaaaatgtttaacttgccgattaccttgaagatactgtgtaatcccctttcgaagcgcacctgtcccttttccatgaacaattgtcaccattggataacccgccaataaagcagagtcaatatatcgatctacctcagtcattgcttcttcataacgtttaccgcgcaaatctaaagttgttttgactgccgaactggtccgtctaattgtagttcgtctcccagcagattcatttttatcaggagcaaccttctccagctcgtcagttggtactttcatctttaggattcccatttggacttcccaatgctttttatccatctgccgtaacaatgaacctcgttgaccatagctcgtaaccatgacatcatcgtttacttttaactcttgtttagctttaacccgttgtagtaccctgtttttcttcaaacttggtgcttgatgcaaagcatttaaaccactcttagaatcaattaactgattttctttaattccagcgccaccttgcatctccatttttcgaagtcttttgataattttatctgctttttcttccgcattatcaactaattcattagcctgttgtttagctttttccaaatactgatctttggaattcactaatttttgatactcattcgttaaatctttatgcaagttttcggcttcatccacttcgaccttcagcttatctgcccgatcggctgcttccttttgacgttcagataggtctttaatcatagcacttaagtcttgactatcctggtccattaacgaccgcgcctgcataatcacacctggttcaatccccaagcgcgtggcaatatcaaacgcattactgcttcctggaattccaaccaatagtttatatgtcggttttagagactccgtatcaaattccatgctagcattcatcgtctctggccgattataaccataagccttcaattctggatagtgagtcgtagccatcacgtagctaccggcactgccaactcgatctaaaattgcaatcgccaatgcggccccttctttaggatccgtcccgccaccaagctcatcaaacaggaccaaactccgatcatcaatctgggctaaaattttcacaatattatccatatgtgatgagaaagtacttaagttctgttcaatagattgttcatcaccaatatcagcaaaaatttcatcgaaaattcccatctgactattctctgcaacgggaataaataaccctgattgggccattaattgtagtaacccaaacgttttcaaagtgattgtcttcccaccagtattaggcccggtgataatcaaggctttatagtcgtcacccaaattaatatcattggcaaccattttcttaggatcaattaacggatgtcgtgcctggcgaaaatgcacatgattttctagcgaaattgaaggttctgttcccttaatctctgcagcgtatcgtgctttcgcattaataaaatctaaatgacctaaaactgccgcattattcaacagttcttctcggtaaggcgccaacagttcagaaagttccgttaaaattctttcttcttcagttttttcttccacttgattttggcgcaactgattatttagatccattactgccgccggttcaatatacattgtttgcccagaagcactttgatcatgaaccacaccaccaaaatgactgcgatactgtgccataactggaatcacataacggccatcccgcatcgtaataattgaatcacttaaatatttagaatcttttccacgggtataaccatccatctttgctcgaatagaactctctgtggtggaaatccggcttcgaatgccaaataacttgtctgaggcttcattggtaatatggccgtctccctcaatcgacttaattaatcgcttggaaatctctggcaaagcttgtaatttagcgacagtttcatacaaggtcctaaaatcaattttttcttcacgtactttttggaaaaaactaatgatgtcctgtgtcgtgcggagcattttagtaatttgagataattccaatccgcttaacgtagcgccaatttcaagtcgtttcatttgtggaccaatattatcaagcttagcgattggaatgccacccttcaatcgataagcatctgcaccatctaaggtttctgtcagtgccaattgaatttggtcaccgtctaccattggtcctaaattatctagttcttgccgaccactttgtgaagctaggtacggctttagtttatcttttactttttcatactctaatgtttcaaaaatcttcttattcattttattatccttttagttatttatccgtattttagcgcattttatcaagcttggatattaaacagtcctcggttatgtttgatcaaacaaaaacgatcaaatctgaatattctcaactcagatttgatcgtttttactacgcttaaatggaaatctattcttcgtcgttatcgcctaagaaagtgttcaacacttcctcgaccatcttccattcatcgtctgattcaatttcagttaattgtcctgcatccgcattaccatcagcatccggtgtatatgagtaagcctgaatatcaacctgctcatcattttctgcatcagaaggatacaaaaacatatatgacttaccataatcttcagaatcaaatgtaaataaaacgttgtaaagctcttcatttccgtgttcgtcaacgagtgtaatttgttgttcctcttcgctcattaggaaacctcactttaaattatttagtagtttgccatgtcgatccaaatagttttctagaatcaagctagccgccaatttatcaataactttttttcgcttttttcgcgatgtatcagcctgttcaattaacattctctgtgcttctactgtagttaatctttcgtcctgataatctacaggtaaatcaaaggtttcaatcataagttgaccgtaagccttggcggcatctacccgaggaccagaagtattattcatattctttggcaaaccaaccacaaagccagtcacatcgtattgcttaaccaattcactaattcgatctaaaccaaactctttttgatcttcattaattttgacaatttcaacaccttgggccgtccagcctaattcatcactgactgccaccccaactgttctggaaccaacatctaaacccattaatctcatttaatatgacctgccgattgtccagatttgtccaaattattattatctttcgaaagatagttacgaaccaactcttcgataatctcatcacgctcatgcttgcgaatcaagttacgagcatcgtttaatctaggaatataggctgggtctcccgagagtaagtatccgacaatttggtcaatcggattatatcccttctcctccaaagcatcataaaccgtctttaaggtttcatgtagatccttaggagcatcattgctaaaatcaaaaaacattgtcttatccaatttactcatcgaaagcacctcctgtactgtcatcaagataattctacccgatcacttaaaaaagtacaaacatagaagtctaatgtaatcaactcgtaacactgctttagtcaactcgcaacattccttatttttctgctagccagtcaatgccatccaccaaggcctgtttgagtccagcaggattactaccaccggcctgtgctaagttgggacgaccgccaccaccaccattgatttgtttggcaatggctttaatcagatcaccggcttttaacccagccttaactttttcatcagaaacagcaaccaacaagttagccttttcaccaacagttgttcccaaaatcaaaacatctgaaattgcacgttgcttccaatcatccgctaaatcacgaagctgtgccattccagaaactttgatgacatcagcaattactgaatactgaccggcttgtttaacattgtcaaacacatttgctgctgcttgtttagccatttttgtttcaagattttcaactttttgtgtcattgctttcaaactatcctgaagttgagccaccttgtttggcgtatctttgacttgaattgccttaaccttttgagcagtttctcgtagaagcttgtcatggctaaccaaatactcgtaagcctcagcagaggtaacggcctctattcggcggacaccggcacccacgccggattcagaaacgatcttaaacagacctaattcattggtgttcttcacatgatcgccaccacaaaattcaactgagtaatcaccaacactaaccacacgaacctttttaccatacttttcactaaataaggcgatggcaccgagctttttagcagattcaatatcagtttcaacagttttaactggaatctcggcaaaaatcttttgattaacaataccttcaactttttgcaaatcagctgatgtcacctgaccaaaatgggtaaaatcaaatcgaaggtaatctggttcaactaatgagcccgcttgctttgtatgcgagccaaatacatctcttaaagcttgatccaacaaatgagtagccgtatgatttttttcaaccttactgtgaaaatgaggatcgacctttaaagcataagttttttcagtttctaatggccgcaacactttaactgtatggagattttggccattgggtgcatgttgcacatctttaacttcagcaaccacattgccatgctcatccgtaatggttcccttatcggccacttgaccacccatttccgcataaaatggtgtaatatcaaaaataagttgagcttcacccttttcagcggcactgacaatcttttcgttttgaataatatcttttaaaacactgtgttcaacattcaattctgaataaccaacataacgacttggcgttttaatattggtcaaaagatcagattgaacacccattgatacccggttaccacgagcggcacgagctcgttgcttttgttgttgcatttctgtcttgaaaccatcttgatcgacctctaagccctcatcgtgagcatattccatggttaagtccaatgggaagccataggtatcaaacaacttaaacgcattagcacctgaaattttagtttcattggctgcctttgttttagcaatgatctgatctaaaagatgaaccccatcatttagagtctcattgaatcgactttcctcagattccacaactttggcaatgtagtctttttgttcaagaacttctgggtaataagatttcataatctcgccgacgaccggaactaatttatacaagaaactcttttcaatacctaacttttgtccgtacatcacagctcttcgaatcaagcgtcgaataacataaccccgcccttcgtttgaaggtagcgccccatccccgattgcaaatgtaatggcacgagcgtgatcggcaataactttaaatgctacatcctgttctttatcatcattgtatgttttaccgctgaaagtttctgtttttcgaattaatggtaaaaatagatcggtttcaaagttagtcggtgcgttttggaaaatagaaaccacccgttcaagccccattcccgtatcaatgtttttatggggaagaggttcatatgaaccatcaggcttgtggttaaactgtgaaaagacaatgttccaaatctctagatagcgctcattttcgccaccaggataattttcaggatcatcatcggctaaattattgaaggattcaccacgatcataaaagatttcagaatctggaccactagggccctcgccaatatcccaaaaattatcttcaacggcaataatatgatctgctggaaccccaacagattcccaatacttcttcgcatcagtatcttttggataaacagtaataaataacttttcaggatccattgcgaaccacttaggacttgttagtagttcccaagcccaggtaatcgcttcttctttaaaataatcacccactgagaaattccctaacatttcaaacaaggtgtggtgccgcgcagtatgacccacgttttcaatatcattagttctgatacttttctgcgaactcgttaaccggggaacctctggaacgacactaccatcaaaatactttttcattgtggcaactccagaattaatccacaataaagttggatcatcgtgcggtactaaagatgcactgggttcaatgatatgaccttttgactgaaagaagtccaaaaacatctgtctaatttcactacttgatttgttttccataacttttccctttctaatcgcataaaaagaccgttgctagtaaagacgccttagcgcggtaccactttacttgcaacgatcttaatcgtttacctcttaaactctttaacgcagagtcgcgaaatacttatcatttgtaaggtagccttaaaaccataaattcgtttttctcattaaccaaaacgtttctgaaaatttattagctttaatatgtccttagccaaaaaccattatattgcagaaaatagctgattgtcaatgctcaccgggatttcgttttgcccgattctgcttgatcttttgccgcttagttctaagaaattcttgatgcttggccactcttcgatcacgctgatcttgaatctcaatagccttcttaattcgacgtttatatcctggcttaactttacgcttactcttcttaaccattcctaccatagttggatccaacttatgatgatcctttacccgcgtagttcggcgattccgatcataagaatccacaacctcaccatttttaatagctttaggctggaacttaacacccaatttttcgatttcagaaactttagcttcttcgccaggttcatataaggtgatggcaattccagacatgccattccggccagttcgaccaacacgatgaataaagaaatctaaatcatctggaataccgtcgttaatgaccatcgaaacaccctcaatatcaatccctcgtgctgctaaatcggtagcaacgacaaattgaaagtcaaggttatgaatttctttcataacccgtttccgttcacgaggcgggaccccaccatgaaccttggcaacttttaggccctgattcttcaggtaataagttagctcatcaacccgttctttagtattacaaaaaatcaaaactaaataaggttcgccaatggtcaataatcgatgaatcacactatttttacccttacttttggttgaaatcaaccaattttcaatagtcgggctaataatactctgcacaggaatctcttcgataacaggattcaccatatattttttcaaaaagatgtttaacgaatgcggaattgttgcggaaaaaaccatcatttgtagtttttttggcaaacttgccgcaatcttgtccacttcatttaagaaacccatatcaagcgtcatatcagcttcatccacaacaaactgagccgccagatggacgtccaaagcttggctactaatcaagtcccaaacacgtcctggggttccaatcacaacttgtggttgacgtcgcttcaatttttcgatttgccgttttttatcagttccacccacataattaccaatttcaatttcattatctgagaactgaactaattggcgcgccgctgtatgaatctggtaggccagctcacggcttggtgtcgtaatgacgacttgaacttgctgcttattcgggtcaatgttattcaaaatcggtagtaaaaaggtatgtgtttttccactacccgtttgcgattggccaatcacacttttcccagcctcaatcaccggaattaatttttcttgaaccggggttggctgaataaaattaatttcttttagtgcagtgatcaaaaatggttgcaaattaaactctgtaaaaccgtttttcattaattactccttcttgctcttctgataggcagtggcaatctcagccaattctttttttatgactgcgacttcatccaaatcttttgcttttgccccacttgccaaagcatgaccgccaccatcatgttttttagcaagttcattaattgttggtgcctttgaccgtaggcgaactcgataagttccgtcgcgttgaatcacaaagattgcccagcaaacaacggaatcaatttttccaggaatcggcacaacaccagcagttcctgcatcctttaaatcaaacttatctaacacttcagcggttaaacaaacagtggctgctcccgcatcggtaatttctaaattttcatacacataagctgatagttttgcaactggtaacgcaatactatccaatttttggttaactgcggtcacatcaaaaccagttgccattaatgaagctgcaacccgcaatgtatgcggtgttgtcgctgaatataagaatcgaccagtatcagcaacaattccagcatacagcgctctggctgcctttggtgttaatgtgagttcctttttaaattgatgataaaaatcataaactatctcagcactactagaagcgtttggcactacccagattaaatcaccatatggatcatcatttggatgatgatcaattttgattaactcttgtccatttgtgtaacgattatcgtccacccggggcggattagcggtatcggtcacaatgactagggcatcatcgtaatcatcatcatcagcaacatccatttcaccaatccaagacaaaccactaatttgtttgccgactgacaaaacagttttcatcgggaaagaggcatgaataatttctgccaaaccaatttgagagccaattgcatcaggatctggccgttggtggcgatgaataataattcgttggtgttttttaatttgttcaaagatttcttgctgcagtgtcataatttcttctttctgtttcaaactaattttaaaaggatcgcgagttttcacttcatcccagtatactaggtttttcaatcaaatacaaaacaagaatctaatcttgcctaaataaaggaagcgacatgttttcgaaattaatacttgctaaatttgtaagcgtaattcccaaaagacggactccccgttgactttctccgaactcatcaaatagttgttgcgcatagaaaagataggtttcttggctattatctaaaaactcagtaagtgtttggcgcttcgtaatggtctcgaaatcagaaaaacgtacttttaagactaaagttttgccatgcttttgcttttgtttcatagtttcagcaaccttttgggccaaatctttcaaagcctcttccacttccgaatcagatactaaattggggttataggtgctttcttttccaattgatttccgctctcgttgatactcaacaggtcgatcatcagccccccgcacatgatgatacaaaacatctccaaaacgaccaaaatgatgaattaactccatttcactttttttataaagatcgcgccctttaaaaatctgaatatcatgcatcttgggaactgtcttcttcccaacgccacgaaacttttcaattggcagtttatccaaaaattcacggacatcttctgataataccactgcaactccaattggtttttgatattctgaagctaatttcgctaaaaatttattgtaagaaattccagtagaacaggttaaatgggtttttgcgtaaatttcgctttgaatttgatgcgccacttctactgcactttcaatttgctttttattatccgtcacatccaaataagcttcatcaaacgcaactggttcaattttttctgtatattctccaaagatttcatgaatttgatcggaaactgcacgatataaagtgaaatctggtgttttaaatacagcctcagggcagagctctaacgccttctgtgcactcattgccgaatggacacctgattggcgagcaaggtagttagccgtggccacaacgccctttccaccagtctgtcgtggatctcgtgcaatcacgagtggtttttttcgtaatttggaattttctcgttcctcaatcgaagcataaaaagcatccatatctacatgaatgatttttctagaggtatccacatgaattggaaccctgtcaatatttgtatccatttctatcacccaaattcagtttatccgaacgtacgtttgaaatcaagttataaaaagagagtacaaaaaaggctcataaaaactattaatcaaaaactgagttaaggagacaactaatgctaattggaattgctatagtttttttgataataggggtaacatccgtattcataaaattattggggaaaaggcgaacaaagccaacaattatgcaaataattcttctgttgggattggttatattaatattagcagcaatctatattacatttgttgttctcgacattcattactagtacattttaagaattctactttttacttaagtgtttagtaagggtagttcgagtcaggaattaggttgagtcgattttgagcgacaactaatcttagatcgccatattttgatggcttttggatgaccgttgcaggtactgatgcagcggttttctttttattaagatataaaaaatggtaattgtgaaattctttaagttatctcgaagattcatcattttatcaccatgcatcgaatgataccataattgtattcactgttccgagaagactatgttgatttgagtggttactggggtgctaattccaacatcaggacaagtaattgtggatgaaggagttcctcatgaaacactggatttctctgagaggatgggtctcatcattgagaacaccacttttcccaaagacctttcaggactccagaacttggtaacattgtccaaaattaaccaagttgcaacgattgaggatatcaaatctgcatttgaaagggttggtttaactgaagatgactggaatatgaaagttgctaactactctctggcaatgaggcagaagttaagcattgctcaagcgatcttcgaacggcctaagctacttttgttagatgaaccaacgaatggcttggacgaagaaagcacttggcttctgagaaagacactcaaagaaattgccgatgctgggagtaccgtgattcttgctagccatgataaagaagatattgcatatctaagtgacgaagtgattcacatggatggtggcaagattgttaataaaaattgatttatcaagaccgttgcgcgtagctgtgtagcggtttttttgcatagatgattaataataatggttttccttgtccttttgccaaaatggcgttatagtgtaatagtaaaatataacactagggaggtgggacaatgaaattcgatgacaagatcccaatttactaccagattaagaattatatctatcgccaaattatcgtgggtgagttggcccctggtgacaagctgccggctgtccggcagttggccgttgaccttaccgtcaatgtcaataccgtccaacgagcattaggcgagctgatttcagagaaaattattgaacctcagcgtggcaagggtaactttgtgacggaggatcgggaaacgattgaaaaactcaaaaagctcctcattacagaacaactccaggatttatatgaaaacctccgcaaacttaatgtgagcgatgaggaaattgtcgattatttgcaggattatatcaataagagaaagcaggtgcaatcatgacaaacacgattgaaatcaagaatttgaattaccggagaaattatcgaagtattttggaagatgttaatttaaacattgagatgggcaagatcgttggcctcctcggtgaaaacggtgctggtaagacgacattgatgcggctgattgccggggttgccaaaggcgcttccggcagcattaccgtggccggcacggatggcgttccagacaagaaatcagccattagcttcagtgaacagttgaatggatttaatcccagcatgcgaattgataagattatccgtttctatgaggacgtctacccggatttctcaaccaaaaagtataacgaaatggctggtttcctccagattgatgaaggtttacggttatcagcactctctaaagggatgaaagagaaactgattatcggattgacgttgtcacgtgataccaaggtctatctgttagatgaaccatttggcgggattgatagtatgtcacggaagaaaatcattcagagtatcatcaaatggaagagtgatgacgccgtgattctggtttccgatcattacgtttccgaaattgccagtatcttggatgaagtcgtgatcatcaaagaccgaacagtttacgcacagaagagtgccgaagagattcgttcaaagtacgctgaaggaatcgaacactattacgaaagtatttatgaagggaatgatatcgatgactagtttctatgacttacttaaatcgctcactcggcccaagttgcggatcatgaaccggattgtcttaattgatgtgattgccattgtattaacgctgatttatcaagtttatcgcggagatctggagaccgatacgccacttgccatcacactttcgtactcggtatttgtcgccatcgttgcctttgtgttgatgtctcggaacagtgagcacattttcgtgagcgacgcctaccggttaattccggcaagtgacaccaagctatactctgttaacctgctatcttcgttcatcgggatggtgtacgccggcattacccaggtagttctgtgggtgatcgctgcgattccgttttggggcgattttggtgctcaatttaagaagatgtttcactacacctatatgcattcggataggccaaactttgtaaagaatatgattcttttgacaattggtacgattttactggcaattgccatgacccttcttttgtgggcgtcgatcacattgatccacttaactgggaacgctctaaccgcgtttctgccagattctagacaaaagttcttcagatttattttgtacattgtcgtcatcgtggcattcctgtatatattctcgatcattgaaaatcgggtagatggcgtgatgaatcacttctttagttctgatacgaacagtgatatgagtctctattacgcaaccatttacttgcttgggttcacggcgttggaatctgttggaagtgtctacctgttaaagcactgggttgaaactgatagttaatcatgaccattgagaaggtcggcacacaattcttgtgaattgtgtaccggcctttttggtttgtcgctcacttctggttgttctcggatagtgatataatcaaaccctaaatatgacgaaacggaaggcaacattttgagaagaacctggtcgatgacgaccttttacctgagttatgtgtttctgattgtactctggtttttcggtcgcgaacttatcaatttcattgagcatcactacacgacagggatggcgagcgatctggttagtttggggatcaaagccgtgatcatggttggtctgggactgttctggatcagtcggacgaacgcccaattatggattgacaaacgcaaactttataacggaaactttccgaccgtattttgggtcgtgttggcaatgttcattgcctatctgtttttcttgatgtttggtgcccaccatggcttttacattcaacccaatccgttcaaaagcggcgagttcttgagtgtgactttgggcgccggcttgattgaagagttcttgtttcgcgggttcctcatgaacttcttgatgaagcgatacgggattgtcaccgccaatattatccaagcaatcttatttcagatcagtcattttccactttactatctggaaggtctgacgttgggcgcttggctcattaacatcgccaacgtgttaccacttggcctgatctttggctggatgttttatcgcaccaagaatctttggcccagcacgattctacattgtgtgtgggattccggcgtcactctgttcatctaaatacctgtataatagtatgcttagattatttgctaggtttctgatgggtttgcgttatacactattctcataagaaaggaggatgataatgcgatttggtgcacgattgaaaactgaacggattgaattgggtttgacgcaaaagcaggttgctgacacaatgaatgtttcccgacaaaccatttccagttgggagactgaaaacagttatcctgacattgatagtttaattcagttaagcgatctattccatatatcattggacgtcctcttgaaggaggatgttgggatgaaggagtacttaaagaaaaaagaagccttggaatggattcggcccattaagcaggttacaatcaccatcgatattttatttattatcagtatgatatttattcggcacggcggagcggcgggcgtgttcctacttttagtagcgctgctgaacatgctcgtcatggtgcgggtcaaacggtttgaggatgagttaaatgctcgaccagccattttacgatggccgaatttgaggaaggttgtttattcctccgcaatatttttgacgattgtcgttgtgtttggttgggtctttcatttacaccttggtgacaatgcatctgcggtggcaattggcttatggcttgggattatcatcgttgagctaacgtatcggtttcaccgacgttcccatgcttcttaatgattattcttgacaggtccgacgtttcttggcataatagtaaccgttactattgagtgtacacaaaataacctaaaacccacaatatcaaaaatacacttatttggaggactcatatggcaaagaagtctaagattgcaaagaataaacgtcaagaagctttgattgaaaagtacgccaacatccgacgtgaattgaaaaaggaaggcaactatgaggccttggccaagctgccaaaggactctaaccctaaccgattgcggaaccgtgacgaattggacggtcgtcctcgcggttatatgcgtaagtttggcatgtcacgtctcaacttccgcaagtatgcccacttgggtcagatccctggtgttcacaaggccagctggtaagataacagcggcaaaggagtgatcgatatggaaaaacaagatctcgcgagtgcttatcgtcgtttgaagagcccaagtatcaagatccgtaagcgggctctgaagattattcatgaagctaaagcgaataaagcgcatcgttaaaagagtccccactgtcgcaattggcagtggggttttattgtatcaaagttatatattagattatatttataataccatatgcaagttgcttgacttaccaccgcaaactttgtacacttacaacaacttcgacacattagggagagcggaatggggcggtttcatgagtgcaaaacgaattgtgtttgcaattatttttgttattttgaatgtagtagcggcttactttctagttgatccattcatgtcaattgtgtatcgacggttccaggaagccgattttttccaaattattctggtgttgacgatcaccttggcactggatattgggacatttcaagaggttgtgaggtagcattaactgtcatcgggattgtcgatggcagttttattttgtttcggttcatgataacctagtagctaatattttaagggggaaatctgattaaaggaagttgttgatctatgggaaaaattcggatcaatcaaacagtggttaaggcgcttttaatatatggcggttttatctggttgattgccttactcattgtattgccgcattttagtgatcttctcccagcaaccgaaaaccttggtgtttctcacgtgtctatcatagatacgacctattttgcttggcgggtgccattaacctttttatttttttcattgatccacacgaagtggtcaatcctgtttccaaccgcttggtattatgccatgtttgcaatttgggcattggtggtcatctttttgtttatcaagggtcaattttggagtggcagttttttcctacttcataccttggcgtttggtgcgagcatctacttcttttccctggtggcattacggacggttcataataatatgtatatcaaaagtgaccactatctggggagatggcttggtgcggttaaaatgtcagttcaggaatactggattgagttaatcagcgcttatttgggatttctgttcttgaatattttttctggataactatttaaaatagtctcgttttgaaaccagtctgttcaaccaaatgaaaaaaccaacaagtagaaacactggcagccaacccaataccagcactagtaggaacgatcctaaaaatccgagtaagccattttcaaaaaatgccttgagcagatcaaaaaagttgctttcatgatgtagccacaagtcgaatggtgttgaaatgacgccgatgacgatggcaaagagcagccatgcatttgcggcgtggattgcttttcgaataatgaatccttcactttctgttgggtttaccatacaaaattttaagacttttcacaacctggaatttttattgaatcagaaaccgggtttcacttttggcagagttcttttatactcgatatatcaatcatttttaaaggagcgttattcattgttattttcaaaaataaagtcaattaccccatctgaactgaagcagttactgccaaataagccggtaattcttgatgttcgtgaggttgatgagtatcaagccggtcacattccagctgcaaagaatgtgccattatctggattgcctggcaacatcgcccaagtatctgccccacagccttggtatttgatttgtcgatctgggcgacgaagtctaagagcggcccggattttgcgcaaggctggttatcaagtgattaatgttagcggcgggatgctgtcttggcaggggccggtgactcggtagatagtttgcgattcttagaattggatttaaaaatgtggcaagatccttacatttaaaggctctggggtaacgctgaatgatttgaccccaaaaacattttttaatattatctagccgaatagtggaaaaatgagcagcttccggccgtaaaaggggactatctaaacatccaacctctggatgtttagatagtccccttttactctggaagcttaacgctcatttttccgcactgttattttcgatcattattcgtcatatcaatcggcttcatccatttatcaaagtcatcagcggtcacatagccaagtgccaaagcggcaactttcagctttgtcccgtcctcatgcgccttttgagcaatctctgctgccttgtggtaaccaatgtgcggtgacaatgccgtgacggtcatgagtgagttgtcgactaactgcttcattcgatcttggttgacggtgatgccagcgaccattttatcggtaaagttcgtcataatcccggttagtaactcgactgactctaagaaactaaatatgatcactggtttataaacgttcatctcaaagttaccctgactggcggcaatttcaattgtcgtatcattgcccattacccgcgtcgccgccatggccatggcttctgcttgagtcgggttgactttacctggcatgatggatgaaccgggttcgttggccgggatgctcaactcaccgtagccggcccgtggcccactggcaagaaaacggatatcattggctattttcagtagatcagctgccagtgttcgcacggctccgtgggttgccgtgatgcctgaatggttggccagaccgtagaactgattttgggttttgaatggcaacccatatgcagtactgagttcggccaccattgcggaagcaaagcccggcgtggtgtttaagccggttccaacggcggtaccgccaatcgggacctctagcaaggtctgactggtttcgtcaaggaagtgaaggtcgtgggtcaatgcactgacccagccactaatttcttggccaaacgtgatcggggtcgcatcttgaagatgggttcgaccaatcttcacaacgtcccaatactgttcttgctttttggttaaaactgcaatcaaatgttcaacctgtggttttagtttgagaacggccaaggtagcagcaatgttcatcgcggtcgggaaagtatcatttgaactctgggagtgattaacatcgtcgttaggcaaaatcgtcagttttgagtccagttgaccgcagaggtttgcgatgacctcattgacattcatattggtttgcgttcccgacccggtttggtaaacgtgaagtggaaagtcagccatgagttggctatcgttgagcgataacaactggcgactggccttttcaatcaaccgggctttttcgggcgttagtgtctgttgcgcttggttaactgtggctgcagcaagcttaatgttgatgagtgcccggatcaccgcaaccggcatcaaagggccggttggaaagttgtgtcggctccgttcagtttgtggcccccatagtgccttctttggtactttgacttttccaagggtatcttcttcaatccgatattcagtcatatgtcctcccgttaatattctggttgccactgagcttgatgaatggcatcgcgaactgattcaattggtttctggttaagtttctgatcaaccgcgctctgtgcgaccgcagttgcgactgtatctgagaactggttgagcttgctgacaggtggtaaaacggcagcccctggctgtgtcggatcgacaataccgccaagtgagtgggcagcagcggagatcattgcatcgttaagcactgatgcggcgctggcaattgctccaagtcccagtccgggatagatgagcgcattgttggcctggccaatctggtaggtaacgcctttgtattctacgttatcagatggaattccggtcgcaatcaatcccttgccgtcagtccatttaattaaatcagctgcgctggcttccatcagcttggttggattggaaatcgggaagataatcggccgttccgtatgggcggccatttcggtcacaacggattttgtgaaggttcccggttgagttgaagttccaaccataaccgtcgggtgcacggctttgacaacggaaagcaaatcagtcaggctgtccgggttcgcaaactcacttcgcgaacgggcgaacggtttttgttccggcgtcaaatcaggggtatcagtgaataacaatccctgtttatcaaccatatagaaatgctgtttcgcttcttccggtgataagccggctgctaacatctcattataaacccgcatggtaatccctgcaccggctgttccggcaccaaagcacaaataagtctggtcagttaacttttgtttggaaatattgagggcaccaatgaggccggcaagaacaataattccagtcccctgaatatcatcgttaaagacgagttggtcatctttataacgattcaaaatattggctgcattggaacgaccaaagtcttcaaaatgcaggtaaacgtctggaaactggttttcgactgcagatacgaatcgatcaatgaactgatcgtatcgttgaccacgcacccgatgctgtttaaggcccaggtatatcgggttcttcagcaacgactcattattggtgccggcatcgataacgaccggcagaacttgactggggtcgattcccgcggccgccgtgtagaccatcagtttgccgacggtaatatcaacaccttgggtgccccagtcgccgatacccaggataccttcgccgtcagtcacacaaagcagccgaatgtcgcgaccatttgcagcattcttgaggctttcttcgattgagtctggatcgtcaattgatagaaatgctgcattttgaggttgaacgaagagttcactgtaatgttcaaccgtagtcgcaattgtcgggtcgtaaacgatcggcatgaattcagcgacgtgttgtgagaatgtcttgaagaataggacgcggttttcattgaaaatactcattaagaacacccgcttctctaaagcagatgattttgattggtactgctgatacacttgttcggcctgctgatccagtgtttgaaccattggcggcaacatcccgaccaaacctaactgttgacgttcagtttctgtaaaggcggttcccttgtttttaaatggatcattcaaaattgattgtgtcatttaaatgcctctttcttgatcatttcctttagaatagtctgttcaactttatatagtcaatatctacatagaccattatgatttataatagttaacataaatatcctttaggaaaggggaaataaacgtgaatatcaacgatttaaaatattacgtttctctatcaaccgaaaagaatttttccagggttgctcaagactattcggtcagccagccgactatctccgccgcgattaagcgacttgaagccgcatttggcagccaactcttagtcaggggaaacccacaccaggcaattaccctgacgactgcgggggagcaactgttagttcatgcaaatgaaattttgtatcattaccgactcgcagtccgggagattgaaaatagtcaccgccagcagttggtgattggaatgccgccgattattgagactaattactttccgatggtcgcaaagcagctgccggtatcagatcttaatcacattcaaactgtcgaagaagggtcgctgtctgcgctccgggatctgaaaagcggtcaattggacgtttcatttttggggtacgtggatgatgtgactgattctgagctgatcgttgatgaatttgatcagcagcacttttcgattctcgttgccaaggacagccccttggccaaactcactgaagtttctttcaaccagttaaagaacgaatcgttcattttatttaaaaataattttgtccacgatcgggtctttcacacccttgctcaacaaaatcacattcggccgcaggtgattttcagatccagtgaggcacaaagcatcgtcaatatggttgccgacggcattggtgtcagcctgttgactcaagcagttaaggttaataatcccaatgtggtcgctttaagattgaccgatgaggcccagccagtcttcaagattggcctggcctatcgacaatcgaccgtttttgtaaacgaccaacagcatattttgacgatgatcagagacgccttgggattgtgagatgacggccagccattgaaatgattttgacaccaacggctttatgaggtatattatatccaaattctaatcattttataatataacacaatgaggacgatggcgtgatgaaaaagattttggcatacaacattttaggatacgaaaaagagtttgtgctcgaatgggcggcggagcatccagatgttcaggttgatttcaatgacgtggaattacacgacgatactgtcgatcttgctaaagggtatgacggcattgattaccgtcagcgcagcatgctcagcgaaacaccggatttatatcgcaaactccgtgattttggcatcacccagctttccttgaggtcggcaggggttgattcttgtaatctaaaatgggccaaagaatatgggttgacgatttccaatgttccctcatattcaccagaagcggtcgctgaaatgacgttgacccatgccctgaatttgatccgccatatcccacaatttcaatcacgaatggccaaaaatgactatattgttgagggcctgcgctcacgggaactatcggaaatgacgattggcatcattggggttggccgcatcggcagcacggttgccaagatttttaaacgttttggcgcccgggtattgggaaatgacattcacgaaaacgacgcgtttcgagatctggttacatatacctccaaggaagacatttttaaaaacgccgatctcatcacaatgcatacctacatgagtgatgagaattaccatatgatcgacaaagcccaatttacgcaaatgaaaccatccgcgtttttcatcaactgttcccgcggtcccatcatcaatacagacgcactgattgatgctctgcaaaatcatcagattgccggagccggcatcgatgtcattgaaaatgagacggagatttttaatcagtcgtttgatggggacattccgcttaaggaatataccaagttgaaggcgatggacaatgttttcttaacgccccatgtggctttttacaccgacattgctgtcaagaatatggtcaaacaatctcttgatgacacgctaaaactaattactggtcagacgacgggccatacgatccatgtgtaatggagaacctctaatgacaaattaaaaaggtgaatcgcaaaccaattcagtaactggtttccgattcaccttttcccaactaacatttacttttaatctcgtcatagccttccaggtaattggcataacgtgcaagggcgaataagtaatccgacaaacggttgagatactcaaagatttcatcattgagcggttgctgcttgtcgtttaattcaacgaccattctttcagctcgtcgtgccaaagcccgggcatattggagcgacgccccggcttgattgccgccagggagaatgaaggctttgatggcaggcaatttggccataatttcatcaatttgtacttccagctttttggtgtcgtcaaaggtaatgttgtggtgacgtttaacggtgatatctgcctgtaattcatacaggtttcgctggattgtttggatggtcggtgccagtgaagcactcttgggggacaggactgaaattacatagccaagccatgaatccagttcatccagtgcccctaatgcctcaatttgcaggtcgtacttcggcaccatttttccggttacctgcttggttttgccgtgatcgccgactttggtgtagatctttaacattgtgatacctccatgatgtatgtaatgaaagaggccagcagcaagttaattgccctggcctctccgtgggaatgatctgttttagggcttggccgatcggcgggggaccgaggggccaaggttgaacgcattattttagcagttgtttttacctagatgaaacgtgctcggaggcaactgacactgcgactcgcactctggttgaaatgtgttccgcaagccagcttcctccgcttaatccgatacacatcttcaatgcgaaaaccgcattaaagatgtgtatcaaattaatgctcggaaactaaacggcttgctccacactctatttcactgggcatgctccgccagcacaatcggtttggtcaaccagttcgatacccttcttatcatggttatcgttttgctttgcgaagaccgttgcgacatcgccgtggatttccattactttgtcttcataagtcttctcgtcaattggttccttaggagcttgtttgaactcattaccaacgtatggcagcaatgaagttgacttggtggtgaagcggtattgtctcatcaatggggcaatttggtcgccttcatctggttggaaagtaacggtacaactaacggcgttgtctgaccagtaagtctgcaggaaggcttgagttgcgaattgttctgcgatcgaaacgtttccggctgaagcgaagttctcgctgtcggcgtgtgatgcgcggattgggaattcggcaaccatggtgctcttggtgtaaacatctggttcaacgtgatagccgcaagccttcaaagctggcagcagtggatctgaatcttggaaacgaatccgttggatcaagtaaccagcatagtggaagtgcatgccttcagagacaccggctaatttggcaaccgttcctgatggcttaacagtggtgtgcttgatggaaggtttgcatccaagtgtatcagagtaatctttatcagcgcggacaacggctttgtacaagccatcaacttctttaacaactcgtggatcgtaaattggcttcttgatagcttcgccagtttcaggatctttagcatcttcataaccggtaacaactcggttaccaaatttagccaaaatccaatcctgaattcctgacattgagataccgatccgacggttattttcaatgacgttccgggaaacttcccagtcgtaattgctgaaagtaacccgctttgagaaacgagttcccaaagtaaaggcttcatcgagatcccaaccttgttgactggcaacgtaagggaagacttcaaacaagttacatggctcaccatttgctaaagaaatttcaccacaggggttggttccttcaacattggcgtcgatgtctttttgcagaccatcgatcttacggccgtagttcttggaaagctccaagttaacaattcctggttcgccattgtgttggattgaatcagcaaccggcccgtagttgtcgaattctgaatcaactgccacactgttgtttgatgcccaacggtgatggtagagcttgtctttatcctgcttcatcgtaataaaatcttcatcgtcagctgagcctaaagccaattcggctgaacgacggacattgccggcaacgacagtctttccgatcaagttgccaatatcagtggcatcaaccgatgacaaatggcggccaacgcgtgaattgagcagactgttaatatcaattaacatttcaatcagtggcattggacctgaagcagttccgccaaagcccttgatcttagcacccttttcacggatgtcgctcatatccagaactaagtcagtcttaccatcggcgttagtgccattgaagtgcatatcaatcaagtgcgcattggcaaccacccaaccttcgcgggtatctggcagacgatagtaacgaacgtctttgattgaatgattcttcaaccattcatctttgtcagttgcacccatatcaagggaatcctggtatgacttgctatccttgtcgatgattactttcaaatcgatctttttatcaactagaggaatcttatgaatattatctttagtgacagaaaaaccaacgccgccgcccttcatcaattggtcaaacatgaatgaataaggcatcgaaacggctggggtgtccggttggagatactctggcaaaatgtggctgtggccatatgattgtgggcgaacagcgatgaaccaacagttgttcaaggcgtcaccgttacggtcctgatagctggtaccagagatccaaaggttacggcctgatggggtagctgaaagaccataaatcagcttgtagagcttcttggcttcttcggttaagtcatcaacaacttggggatcaacgttgtcttcgtgcagacgagggtcaaggttgatgttgccttcaaccacccgtttaacggtttcgtcccagttttcagtacggcccttttcaggcagccaacgggcataagtccgcttgtaggtaacccagcctaattctccccagtgaggtgtaacttcttctttaacttgttttataaattcatcagatagtgaaactgatgaaagtttcattgcttgcataatgattcctcccatatgtacattatattctcatttcgtttgaattgctcgaactgatactatatatagtatatctaaccggtttcagaatcaatatattgtgtattcggtagatttgcttgtaccctgcataatcgcgtggactcgcggattggtgagcttcaaaaaaatttgaatcacactaagggtggttttgggagtgacaaatagttggattgattgagacccattttggctatatatgggggtatcttgtggatgattcccaaaatagaccacataatgtgtcgtcttaggtgacggattgtgagctgaaagtgacattttgacgtttttgctgtaaaattcgtgtctggactatcatatgtggataaaaaggataaaatggagtattatcatatacatagacgaacaaaaaacataaaagtagaaatttcgttaacagttgtggctgtgaaaagcctcgattttcacacatattagtcgtttttggtactttctttctatcttatataatctggaggatcaagatgcagaaggaatatgaattaacaattggtaaactgaagcggacactaccgattatcccgatcacagacacggcggcaattgcctccttcgtcttattgggggatgctgagttaacccgttatgccgctcaggagttggccaagcggattaacattccgtttgattatctggtgacattggagagcaaagggatcccattggctcaagaactgagcatgattacccatcacccacgttatttcgtcttgcgaaagagtgttaaggcgtacatgcgaaacccaattgcgattgggatgcgttcgattaccactgattatcatcaacagctggttttggatgggtgtgacgcagaacagcttcgaggcaaacaggtgatcattgtggatgatgtgatcagtacaggcggctcactggcttcggcagaacacttgttgaagaaagtgggtgccaatgttgtgcaacgctgttccattttagccgagggacgggcaactagtcgagatgactgtgtattcttgaatactttgccggtgtttgcggtgaagaacgcttaacatatgattataaactgaccgacgccgtaaatcttgtttgagatttacggcgccggtttttggaattgtcgtgtcattatgggagattcttatacttggagaatccatcgatcaagaagtttgagatggcaagccatgtgataaagagggcgatgttggctattagttgaagctttaagagtaagaacagaaaaccaatcgtcgaaactgtgatgatgatcattgaagttgtgccgcgctgatagttatgggaaattaaattcaggatgaagagagtagactttccaaccagcataggtataccatgcgagccagattacaacgacggcaagaattagccagattgaatcaatgtgtaatgcagtcataccaatatagacgatcaatgtgaggaacattggtgcgttagtgaatagagcgtatttccagttaaatatcattttgcagctctcctgtaggatttgaagccgttaatgacggagtagaataaaccaaatgccaatagatagccttctggactttgtggataaagcctgagaattatgaggccaaccatgacgatgatccacagtgccaagacaacgtttgccactgtgttgaattcaaagttttgtagatcaagttcaggatggttactgaagaaagtcttggcatacttataatgaacaaaaatatatccggctgaaaaaacacctaaagtgaatagcaaagcgatgacatcatttgttatgtataaatggattaacaaataaatggcgatcaaagggatgtatggggaaaagctaatcagtgtgatcttccaattgattttcatgaaacaactctccttgtagtaagattcccccaaccctcagaaaattgttgctttcagcgtatcatatacgaagaaaatcgtaaaatactcttcaaaatatggtaaactttgggtattcaaataagatcactaggggtgccttgtgctgagatggtgacttgccaatccctttgaacctgatttggttaataccaacgtagggaagtggaataatgagttcgaaaagtgccaagtccggtcgcgttctatttgaaaattttgctttaaggagcactgacccatgaaattttctgaagaattagtcgcagctggacagccaattttacacgagatctatcaacatccgtttgtcgaaggaatcggcaatggagaattacccaagaagccttgtccttttatgttggtcaggactacaactatctgaatgcgttcatcaaggtgtacgccgatgccattcaaaaatcgcaaaccagagccgatatggctatttttgccaaacaaattgactttatcctgaatagtgaaatccatccgcatcacaacttctgcaacgtggcaggggtcgaatacgaaaccctgcagcacgaaccacaagctcccggcacatacctgtacaacgaacacatgtatcgtgctgcgcgaactggcgacttgattgatgttgttgcggccatgaccccgtgtccatggacttacctggaaatcgcaaaccggtttgtgaagcaggggaagaataccgacgacaatgtttttaaaccatggattgatttttacgctgacatggaagatgacagtgacagcattttgccccagttatttgctttgattgaccgtgaagcggaacactacgatcaacatcatctggatgtggtcaaagaagaattcttgaagagctgcgaactggaatgggaattctgggatcaagcgtaccatcaacgcagttggcactttgttaaaccaatgaaacagtatcgataattaaaatgattctgagcaggattgcaagtttgcgatcctgctttttatgtacaaatccattgacatcaaatgttttccgtaaaatccgccagacgattatggtatgataagctcaaaagaaatgggaggtattcgcatgctcacgatcaatcatctccacaaacaatttggcagtctgactgcattggacgacattagttttgatgttcccgacaaccagatcaccggattaatcggccaaaacggctctggaaaatcgaccacctttcacagcatcctaaactttctcaagtatgatggtcaaatccgctggagtggtcagcccatcaaagaggctgattttgatgcaattggctacctgcctgaagaacgcagcttgatgcccaaactaaccattgagcagcagattgtctatttagcacgattgaaggggaaacctgcaaaagaaattcgcccacaaattgacgactggctgaaaaagtttgcggttaaaggtaagaaaactgataagattaaggatctctcaaagggaaaccagcagaaagtgcaactgattgtgaccctaattcatcatcccaaattgattatcttggatgagccctttagtggcctggacccggtaaatgcggatttgttgaaaaaggcaattctggaagcacgggatcagggggcagcaattatcttctccagccatgatatggcgaatgttgaggcagtttgcgatcgactggttatgctacggacgggtgaagtggtcttaaacggcaccatcagcgaagttcgcgatcagtttggcaaatcagaaatttttgtcactaccgattggactgaagaacagctgaaccagctcccacatgttgttaaagtccagaatattcgcggttctcggttcttgttgcgattggatgatcccagtaagggacccgaagtctttgagaagctcactgacggtaaatacatcgaagaatttagtcagcagccaccaacacttgatgaaattttcagaatgaaagcggggatctctcatgaataaaaccctaattgttgccatggaaacctatctccgccaagttaagtcttggagcttcatcgtcttggtgctgtctccgttcattttgttggcaatttctttaggcatcggctacaccagtgcgacttccagttcagatcaacagcgaattgccgtcatttctgatcaaccggcactccgaaggcaatttatcaaagccaatcgggatgacgtgaaggccagcatcaccaccactgcagccgctaagaaaagtgtcagcaataataatttagctggctacctggtgttatcggcggacaaggcaaaagtcagtggtgtctatcattcaagtgattctctaggcggcgggatgagaactaaaatcaacgtctttcttgcccagtcccagcaacagcttaacctggcgaacgcaaagttgagtgccaaacaaaccaaatcactggcagttcagccgtctttcaaacaaaaaattcaaaccaaccatggcggtgccaacctggcgaaaatcatttcattttgggtattagtcttcatgatctatatgattttgatcacttactcttctgtgaccgcccaagaaattgcttccgagaagggcactaaagtcatggagattattttctccagcaccaaagcctcgaagtactttgtcggcaaaattcttggtgtctttggcgttatcctgacccagatcatcgtctatattgttggtggttacggctttttccagatcgccatgcacctggataacattaaacagctaatttcggacaaccagacactggtcaatgacgtgattaaaaacatgctgggaatcaacctgctatttgtcttcttaggcgtgatcatttacacgatcatctcggcatttagtggtgcactggttgccaaagcagaagatgccccgaaagctgctcagcctgccatctatctgagtatgattgccttcttcttgacgatgccgtttcaaagcaattcagacgcgctgatttcaaaaattttgtcgtatgtgccattcttctcgtcgtatttcatgcccatgagaattatcaatgacaacgcgagtgggttggaaattagcatttcactggcgattctggtcattagcatcggccttttgacttggtacattggtcagatctatgaaggcttgattttacagaccgacgacaccagtttttggaaacgtctgcggcggggtttgtcataccaaaaataaattagaacaaaagtagtttgagacaacactgtttgctagttgtatctcggtttctatcaggatctaatgctagactctttgagccccattattatccagaacaaacgtgcggcaatcggctgatcccagaatttacgcaaataaacgagttatcccaagcacaggaatgactcgtttatttgcgtaaattctgggattaaaagacaacgcccccgctctcttgcgtatatattcactaaaggcgatatttcaccccatttttctgatataattaattggctggtacataggaggaaaacatcatgaaaaagttattattgcttgccctggtgacatttggcgtcttcaccgctacaagctttccagtttcaggaaacaccaccgcggctactgccaattcgaccgcaacgaacaccgattcaagttacatatggacaaaagtgttgagtcgcagcacggccgtggcctatcacgctaaatccaaaagtgcagtttatttgtggaatgcgacccacaccaaacggctgcataacctcaaaaattacccgaacacaacttggtacgttaaaaatagtgttgtgatgcagcatggcaattcaagccatgtttactacgaagtttacaactatgggaatggcgctgacggctttatttggcgcaactatctgactaagggcgttaatccctcacgtcatgcttctgccgcaaagggtgttatttcgctctcagctcagcgatcacttcaattctttgaggataatttgacaactttggcaagtttgccgcaaagtcaatttcaaaagttggtgatggatcaagtggctgccaaattaacccaaagtgccgctgataccaaattagacgcaatggccaagctgcttgccactcaggatatcagtaccagagatgccgcggccaaagcaggcgtgacaaatgcaaaagcaactaattttaccgttaaacaggtcgatcccaaaacaatgaccggctattattcttattggtccaaatatcggacaaccaatgccttgaagtattatgccgctgtggttgccagtcacgtcaccagcttgaccaccaattccgttaatggccattatggtgtctacatcgttcctgatacaacggccaaaacatggaaaccccaactcacaattgtcactgactaattaattcaatccacaaggaggtggttatttgctagaaaacctgaagctgcggcgctcgacttacctgatttttattgtttggggagcgattgccttctttttagcatcggtgatttttaaattccagccgttagccgtcagcttttccatcaatgatcaccgcctacttcaagggctgctgcggggaattttgttgttggccgcttatgtggtgatcacaatttttcccaccagaattgccattgtcattcccagtttcttttattttggtatgcttggatcgtatctctggcagttcttgatggttgtgttaaccggaaattggcgaggaattgccatggatctgttatttgtgatttcttacatcgtcttgatatattgcgccacaatgactgcctttcagattatcaatgtggttcagaagaaccgctcggtttactatttctcaaagtggttcaaatccgtcaaaagagtgctgaaggcccactggctgtcgcttctggttgtgaccggagcctacgtggtcttgtggtctatgtttaacctgacttaaatgcgaataaggagtatctgatgaaaaaagtaattattgcagcagttgcggtcatgggcatcgtcctggctggctgttcatcaaagcaatcgactaataaaccctctgatactgttaccattgtgaatcacgcacagaaggccgctcatgggattaagagtggcaatgttgtgttggttaataaaaatacgcaaaataaaaaaacatccactggcaaatttactgccaagttccaccttgatccaatgatcgttcaagctaaactgaataatgccactggtttggttaaaaattatgattacttcattgatggccggactgtctacattcatgctgataatagctggtccaaacaacgcctgcctaaaaagagcccactgattaaaagtgttcgtcgacaggtctccggaagcgctgcggttaaagccatgcagtatttgaagaagcatctgaagctccaaaagaaccagacaaccgatgtcctctcatataatggccacggcaagctagggtcgatggttgccaagaagcttattttggctgaagcaaataacagcgagagtaccaagaatgtcttgaaaaaggtcacgattaccaaatttgtttacaaatatacattgaataagaagacttatctgccaaccaatacctatatttatatgcagtatcaggataaatcatcaaagaagtcgattaccgaggaggtcaccagcacctattcaaatgtgaaccaagtgaagaaatttaaggtaccggatgctattaagcacaatgcaccaagtaccaatcaggtcaacgagtaagctgccatggggatgtcgccgacaaacgctttgagaagtgacatctgtctgcaaccatgattaaagcttggtaaaggttgctgtggcagcattgtgttgccttaatttcagaatacaatagcagtaaatattttttaggggatcatcgatatggacaatacacaatcattggaagttaaatacccacaggttaaagacttgatgaatgaaacgccaattttttggaaaaatcctgattatggccagcctgcagagctaccgttttcaaaagctgatatttttgacgcagttgcccgttgggatcgctttgcaccgtttattgaagctgctttcccagagactgctcggatgcacggggtgattgaatcaccattaatcgagctgaccaaaatgaagtcggcttggaatcaggcccagcccactgcgctggcaggcagcctctacttgaaaactgatagtgaattacctatccccggatcgatcaaatcacgcggtggaatctatgaagtattaaaattcgccgaacatgtcgccatgaccaaaggcgatcttaaagaaactgataactatgcgattttaagatcgccggaatataagcaattgtttgcccaatatggcgtgatggttgcctctactgggaatctggcgttaagtgtgggcatcgccgcttcaacatttggcttcaagacaaccgtttatatgtcacgggatgccaaagcctggaaaaaggccaaacttcgggtcaatggggttaatgtggtcgagttggatactgatttttcctcggtcattccacaagctcgacaggcagcagcggaagatccgagcattcattttatcgatgatgagggatcagctgacttattcattggttatgcagttgcggccgttcgcctgcagcaacaatttaaacagcagggaatcaaagttgatcgcgatcatccagtgattgtctatcttcccgctggtgttggcggtagtcccagtggcgtgacgtttggactcaagaccattattgggccatacatccacgccatcttctgtgagccaactcacgttccatccgtgacgttggggatgatgacgaagctgaataatgcgatttcggtctttgatatcggcttggacggtaagacggcagctgacggtttggcagttggccggccatcacgcattgccggtaagatgatgcggacactattatttggcagcgttactttcgaagatccaatgatttacaaatatgaagcccagctgatggacactgagaatatcacagtcgaaccatcagctgcggctggctttaccgcaatcgaacgggcaattaccgaagtgccggcctttaacaccgctaatgccacccacattgtctgggcaaccggcggcagtatgatgccggaaagtgaacggctagttgatcacgataagggtgaagcattgctttaaacatcaaagagagtgggacacgaggcgttttgatcccagaatttaagccaagaagcgagttattcctgttttggaatgactcgcttcttggcttaaatggccgggatcagccgatagttccacgtttaaacaagataccagtggagcctcaaacttttttcattttgcttttttaaaatatttttgacttaacaatagtaataccaacatcaagcagccaatcacgccaaagccaaacgagaatgtttgaatctgaaccagccagcccattagtgggaataaaaagatcattgaagctgaaaacagaacgctggcaacactcagtaaagttgcccgctgttgtgaagtaatcatttcattgtagtagctgctgaagatcggctcaattaatgacgccagtagttgggaaaacaaaaacaggacggttaacgttggaatccagttaatccatgtgagcagcagtagcccgaccaacgttgcacttacgccacttaccaacgccggctttgccaagcgtttctgaatccacggggtcaatttgatgccgacgatgttcattccagcagaaatcaccatcaacaaggagatcatgaagccagagaaatggtgcgtttccattaaggattggaaatagaagtaatagctggtacaaatcccatcaaagaccgcttggaaaatcatcaaaccgcggagttgttggttatttttcaacgtccgataggccatgacgatgattgatttgactgtctgttttggcagatcaattgacttggggacagtcggttccttcattaataaaacggttatcaggccgaaaataccgatcagaattgccgcgacgtaggtcaattcgaaatgccagtggaccaaaaatccggcaatcacgacacctgccgtctgcgaaaactcaatcaccacgttgagattgctgataacattggggaatcgtttggtttgttgaggggccaccaatgaatcgtacatgagcgcgtcgattgtccctgattggagattatacgacagcgcactcagcacgaagctcagggcaaacagccagaaactgtgggctaccagtatgaggatggcggaaacgattgaggcaattcggccccagaaaagtgagaaacgataggaaaagcgatcggccaatacgcccgatggcacttcgaaaacaaaactggcaacgtggaagatgctttcacataaaccgatttctactagatttagcccctgcatctgcaggtaaatcacccaaagtgaagtgatcccgaaaaaggaaaagaaagtgtacgcgtagcctttgaaaatagtacttggatatttaattgtcattagatgcactccagttaagataagcacagccaaacggtttatttgaaacctgtccgtttggggatgtgccaagtgtcattcatcactgaagtgcaacggtctctacgatgctgtgttgcaggctgatccaggcgagcatgttcatcattcctttacataattatgagaaacttttaataaaagcgtacctgtttttcgttcctgaggcaactcataaaaatctgccagttagatggcacctggcagacggtttgaaacgattaacgctgtttaaaatccagcaacccgctcattcccagaacaattccaataaaagtgaaaaacgtcccggtccgaaaattaaatagtgcatcgataatgagaccaccaaccaaaccaatggccaatcccagccagtgagtttgctggcgatcagttgcttgcgagtatttttccctgcttttatccataacgacgcctcttttcgattggctaacagctagtcgacatcccaaacttctcgggcgatatctctgaccagtttaagtttgtcccattgctgctgttcggtgagcttgttaccctcttcagttgaggcaaagccacattgcgtcgagagcgccaagttttccagtgggacctggccgctggcttgatgaatccggttgatgaccgcgtctttgtcttctaattcaggtgatttggaagtgatcaagccaaggacaattcgtttgtttttatcgccattccaaatcttgccaagtggtgagaagtcaccagctcgctcactgtcgtattccaggaacaagccatcgtaattgagttgacccagatactctgctacatcgtcataaccgccggaaaataggaaggtggatttaaagttgccacgacaaatgtgagtcgtcacggtcaagtcgttcggcaaaccagtcagcagctggttaatgactttgacagaatcttcggctaatttgacgtatttcgcatgggcatccgcgtcgtgaacggtttcgtttaacttgctgattagaaatgcccaagtggtgtcatctaattgaacgtagcgggcaccgagttcatagaagtgcaaaatcgtttcatggtaggccttggcgacatcagtcaaatattgatcccaggcatcatagaactttgaccaattatcactgcgattgtcgcggaaaagcatcgttggcgacgggatggtttgcttgggggtcacactatccggggtaattgattgaaggaacttgaagctgtcaaagaagggatggtttgggttgaaggcgactttgccggccaattcagcgttatcagtccgcgtcttactgccgtggaacttgtaactcttgtgatagtcgtatttttggacaccggttaatccccaaagaaagtccaggtgccaccagctgcggttaaattcaccgtcggtaatgtctttgaggccaagctcaacttgtttatcaacaatcttctttgtttcagcgtgttgaactttttgtaggtcagctgtactgatttggccggcatgatacttggcgtgggcgtcttttaacgcctgtgttcttaataaactgccgacaacgtcgtaccgatatggaaatttagttgtaattgctgtatttgtcatgtgaaaatcctcctgtaattgtaaaagttttacttacgaaaaaaagcactcgtcccctgactgtcaaattgacaatcaagggacgaatgctcgtgttaccacccttattcacgttgcctttgcaaacaacgcctcaacggtacctatgatacccgggaagttaacggttcctaccgattaatccgcgtgaacggcttaatgccctttggagctcatcttcaccgtcatttcgatacctgctctcatctgccaggctttctgaaatcgatctgagtggttactcttctcctcatagcttgataattcgtaagttttctaattgctttttaatctaactcaaatataagtgaatgtcaacttattgtttcatcccgttgacgatttcgccaaccaaatagtgggatgatcaacaaaaccagattgatcatcaaggcggccacaaagacttttggcccggcagcatgaagcaggtaggcactgaagataatgccgagaataaacatgataatcccactcaaaaagcggccggctttgagcaaagcttcacgatcgtggctaaagatggcttcataggaattatttgcaaaatttttcaaattcccagtcatgatgccgttgttcacactggtcgtgccaatcttgttgaacacggtcagttcataacctgagaagaggccgaggctgaataacatgttgagcatcgacaggtggaatgctgccgccactgccagaattcccaataggatgatactgaacagcaagaggacgttgaaccggcggtcgcttgccagttgaatgtgtttaaaggcttgtgagatgaatgctccgagtaggaatcctagtaataccggtacgcgaatgtaagccgtactccaacccttggtggcgagttcgtaagcgaaaacaaccaggtttccggtttgcgcactcacaaatgaaccgtcaaaattttgaaaggtgtaggcatcaattgagcccatgataaaagtttgcgccagggttgtgatgccggttttagtggcaaagttcatggtgatcactcttttctatattccaaactatttacagctctactataccagagtcactgacattaacagcaaactgtctattgtttcttctgggattcttggtatacttaaaatacttttgatgagagaatgttacatttaatgtgtaaggtattaacttttagattggcaatggggtacaatatttgtaacaaacatgattggaaggatgatcattatcaagccgagtgtattaattgcagaagatttttccgcggtcggcaggctttcggctactgccgccatcgccgtattttcagcgtttggactgcaaacggcaaccttgccgacagaactgctttcaactcaaacagaaggttttggaacgcctactactcagaatactgattcttttatcaggcgggcaactggtcactggaatgggttggatgatcttcaatttaattcaggaatcgttggttacgttggtaagattagtacggctaaccttttgtacgactatctctcgggagttagcctgcctgacctgctgattgatccggttttgggtgatcagggtaaaatgtatgccggctttgaacctggctacttggatgccattaagcgactcgcatcaattgccacgattattaccccaaacattaccgaattggggctgctcagtggagaacgcctccgagttaatgccagtgatgaccgaattcatcaagctgttaccgattatcgtgaagcgacccactccaaagccaaggtaattgtcaccggagtccaccgtgacggtgggattggctgtgtctatgtcaacggcgaccaactcaaatgggccggctcgcctttaatcggcggtcatttttatggcaccggtgatctattttcagcactgttaattgggtatttgaactttaagctggattttgatacagcggttcaaaacgcagttattggggtgtacgatgcggtgagtctgaccagccgcgcaccacagcaccaacggaaatttgggttgaatttgaccaggtcattgtacaatgtggcgaagtttacgttaggacaaacaggggaagaagtgtaaaagatggatttacaaacaatcaagcgtgatttgtcggctgtcttaactgaatattttgagcgggtgacattcccggaaaatggcatttttgtggttggctgcagtaccagtgaaatttctggtgactggaaggggactaattccagattggacgttggtcgagccgttgtgtcgactttggaagaatttttaattccacgcaatattcatgttgccattcagggctgtgagcacatcaaccgggccctcttggttgaacggaaggttgccgagcgcaataatttagaaattgtttccgtggttccggcaatgcatgccggtggcggtacgcaagtcgctgcttatgaacgaatggatgacccagttgaagtggagcacatcacggcatttggcggtatcgacatcgggggaaccgagattgggatgcacgttaaatacgttcagattccagtccgcatgaccaatcgccgtgtcggtgcggcgaatgtggtctgcctttcttcacggccaaaattgattggcggaagtcgggccaagtatgattttactgaagcaaataaagaagattatgtattgggaggaagtcagtaatggatcgtaaaagtgtaggcggcaaggtcagcagtgatattttcaaggttgttttaacggcgatgtttatcgccgtcacggttgcgatcagccgcttttttatcatcccaattccaatgacccatggcaatatcaatctgtgtgacgctggaatctttatcagcgcgctgttgctgggaccgagagtcggcggagttgtcggtggtgccagtggtttcttgttggacctgatctccggttatggtcaatatatgtggttttcactgattgtccacggcgcagaaggcttgattgtcggcttgatcgctggtaaaaataccgatcgcaagtggaccaagctgatcgccgtttcagtcgggatcgtcattatggtaatcggctattttgtggcagactcggttctgtataacatttatgccggctatattgggattggcaccaacttgattcaaggagcagtcggtgccttaattgcttatttggtaacgccacggcttaagaagcgcatctagtatgaggtaatcgtcatttgggtctgcagattatcctgtagacttttttgttttacagctttaagtggcgttggaaaagagaatttgaattttgtcttgccgaaattgtagtaattcagtgatgccgttgcgggtaaacagtgtttgagctaccaaattcgcccggttaaagttcatcctcaaaatagccgagtcgcaggccgccggcattgccagcagtagtgtccatgctgttgaagcgactgaaagtcgcgattacagcatcttggtatttcgagactacaggctcgaaatccaagccactacagcaggcagagccggcggcctgcgactctgcggcagtaatcagcacatctaatagatttctgttgaacaagtaagcataagcaacagatgccacattgcgaccaaccaagaaaagatttacaatatgacacaattacataggagggatgtctgaatgactgataagaatagtgttttaacggagcaagatttttcagcactccacaatgatttcaagaatgcacctaagagtgatgtgctgtcgaagataatcgaacaaaacggcatcaaccaagcagctcaggatccggatgcccaagtgcgattgaatccagtattttcagtggacctccagaccggttcggtgaccaaccagaagcaaagtggtcgctgctggctgttttctttggtgaacactttacggcatcagtttgctgctaagtataaggtgaaggatttcaacctttcacaaaaatacctgttcttctgggataaaattgagcgcgccaacatcttctatgaccgaattttagcgaccgccagtcggccggctaatgaccgggaagttgaaaattatttgagcttccctggcgacgatggcggccaatgggcgatggcagcggcattggtccaaaaatatggtgtgatgccggtcagtgattttccggaaacggcgaacgttgagaataccggtgcttttgatacggttatgaaccgcaaactgcggattgacgctgccaaactgcggtcgatggtcaaggatgaaaagagcgatgaggcgatcagtgtcgctcgcaaacaaatgctgagtgaagtctaccgaatcacggcctattcattcggtgaaccaccggcaaccgttgattttgcctatcgcgacgatgacaaaaagtatcatcgggtctccggtctaccccctcaacaattctatgatcaatacttcggtgtcgatttggatgattatgtggtgttagctaattccccggaaaaagattacaaccaattatattcactgccaagtcaaaataacgttgtcggcggcaagcagattgccttcttaaatctgccgatggacgttttaaaggccgctaccattgcccaactcaaggatggcgaaacggtctggtttggcaacgatgtgcttgaacaaatggaccgcaagaaaggctatctggacagtcacttgtatcgctacacgaaactgttcgatgtcgacttggagatggacaaggcagcccggctgcaatatcatcaagccgaagtgtcgcacgcgatgactttcactggggttgaccttgatggtgagacgcccactaaatggaaagttgaaaattcctggggtgacaagaatggtgagaagggctacttcaccatgagtgacgattggatggacgactacgtctacgaagtcgtggtccacaaaaaatacctttcagatgatcaaaaggccctattgaagcaagcaccagtggagctgccggcgtgggactccttggcgtagggttgaagctgaatggcttgatgcaaattagacgttgcctaaattgatttagaagaatattaggttatcaaaaagggaatcccagctgggattccctttttgatgtcttggataactaattttcttcatcctgcaattcattcgaataaatcaacaaccgctgagcataacttggatgatcaaacgtagaattgatggttgattgaagctcagttaagttgtcagtaataatcccgtcaacgttcaagaatagcattcgggtcatgtcgtcttcgtcatcgaccgtccaggcatacacttgttggtggtggaaatgcgcctcgttgacaaacgtttcgttcaacgtggtttcttccatggtgtaagcattggccttggtttgggggaacgagaagttgtacggcaaaatatagctgacaaataatttaggagcctgcttctttaagccgctgatcacatgataatccagtgaatggatccgatcgtgatcccgcagcaggcggttttcgtaacgtttaataaatagctgcagcatgttttgactatcgtgacgagtagttttaatttcaaccaatagcttttggtgatcatgttcagcagcccgcagatactgattaaagctggcaatgtgggccgtgtggccgttctcatgaactttcatcttggtcatttgggagagggtcaattgataaggatctttattcaccccggccaggttccacagattttcatcgtgcatgaccacaaattgatgatcgcgggtttcgtggaggtccatttcaacgtaatcaggcttttctttgctggttttgttcaacgccggaattgtattttgaacaccgttaccgtcatctaccccacggtgggaaatcgtgatgggtttggtcagcagtgctccttgaagatagacagcattaaaggccacgtctccgaccaaaaacaggccaatcagaagggctcccatgacccgccgaccaatccgtcgctttcggggtaaacggaccacagccgccgttgaatgccatttggactcatccaagaccattaacaagatgagcatgaagacaaccacactaaacgaggcgacaattcgttgccagacggtcaacaggcccatgttggtgaccgcaccaacaaagctaatcacttttgactgggcatccaggtaagtctggaaaaggtaaagtaaatacgataccaaggtcgttgacgcgaagctgatgattcccagtacgaagatccgccagagatactgccaggtattgtggctggtcaactgccagctgttcttggcggcttccaggcccttttgatggtgaataatcatcatcggcaggacttggatcagtcgaattcccaagtaaaagacggcaacgcccaggactgtgagcaggattgcaatcaacggattcttttccaaatcgtccaagataaagacggggatggtcgcttttgaaagcagtggtgagttcaggtaggcaactgaaaatggcagaactaaaataaaatagccaataaagaacaggaagctgcccagtcgcaatccacgcatgtcatggatggcaattttaaaaactccccagagactcaaattttgtttgagggcgatgttgttaatcccagagagcagaaacgcgaactgccaaaagaccatcgcaaagataaccagcagcaaaatgaacagttccaccaccgccagtggtcgttgggtcaaaagccagaccgcattcgtatacgataagtaggggatccggttcacttggagaatcaggccagtcatatactgcatgattggcacaacaacgatgcccaacagtagattaatcacaataactaaactgacgtaagccccccaattctgaaaaaacgttctgattgaccgctgtaatagtttgttgcccttcatgttcgaataccttctttgatcaagttgaatggttttatcctaccataactgactgtttaacagcgaaataaggcccgtgggctggtaacgcgctccttttgaggcttacgcaggatacaaaaaaacaacggcaaaagtgattctgccattgtctcttctggtaaaattaattagtctttgggcgttacccaaacttggggagccggatcgttatccaggtttcgaacgaccttatagccggtcactgccagcttagactggtggttcttgccgctaacggtatttttcactgaaattgtctgatgcattgggatatccgaaagtttacccttcatgtaaatcaccggtttgtcagccgagtcattcttgaaggtgtacttcaaagttccctgtttgtccagatcatttgcctgcttagcttcactgtaggtcttgtacatcttgttgacactgtaaatggtcacggtatggttcttagaattgaatttgtaggcatcgatgcctgatttactgttgtaattaatcgaaccattcatgtaccaaagattatcgcttgatgttaacagttgcttagcggatttatcttgagtctcgttttgcatgctggccttattagaattgttgttggaactcttatttgaagaactgctgcagccagccaaaattagtgcaaagcttgcaacaaccgccaagatggcagctaatgatctgtgctttttcatttccataatcacctcatacgttgaaattatcacataatactgtcaaaatctagtagtagcgttcaatattaataattgatacaaaagtttaacaagatcgcaacttcaaaaagggtaaaatttagtagaggggaggcaattcaaatggttacaatccgagacattgccagacggctgggcttatcggtttccaccgtgtcacgggcactcaatgataataaacgcatcagtctcaagactcgccgcagcgtcaagaaaacggcggatttgatggggtatcagcccaactataacgctaagaatctgaccaatcgtgaagccaataccgtcggcgtcgtcttcccagttaataaccgggttgtcgacaatattttttacgttggtattttgcgggggattaacgcgcagctcaacagccgcaattacgtcctatcaatcgcgattggagacagtactgaacaggtaatcgagaatgttaaatcaatgattacccgcgcccaaatcaaacattttatcctgctatactcccaccaaaatgacccagtcatcgaaatgctgcaaaaagaaaacgttgattttgtgacaattggtaaaccggcggccggacaagattggctgtatgtcgataacgataacgtccaggccggatttgacggcaccaactacttaattgatcactatcagtgccagaatccaatttttgtccaaacccataacggttggccgtatgaaattgatcggcgcaagggttacctggcagcgatgaagcaggccggcaaatcgcctgtcgtgctgtcaactcaagagaatgatgaattagaagatcagttcattcgcgacaatccgcagatggatggaatcgtcgccattgatgattacagtggcctgcaaatgtaccaccgtttcaaaatgattaatcctaataaaaacgttgaagttcttggttacaacaattcactaccaagtgaactcaccgatcagcatttccattctgttgatattcatccagatgaaatggggcagtcggcagttaagctattactggataaaccagcagaggatgagcaggtaattgatcacatcattgttggacatgagattctgtagattgggaggattgatttcatacttcaaaaatgtgtgttttgcattcaattcagcagttaataaccaaaggatatcaggaaatgtttaaagataactggtggccactaccgattctcaacggtattatcggcatctctatttaccccttctggtaattggcgtgaataacatttacactagtaaaaaaaactgaaagtgtaattcatttcagttcacctcatcatgtagttgtgaaactacttttttaaataactgttaagcaacattaagtaagcagttgtagtatttacaaattcggtgacggactcacgatttatttccgataataatggattcagatatccgaaatatccgttttcccgttgctgggccttaacaaatcgtgtaattgtatttttcaattctacagagtcactttgtgttagcagcattatcgaactggtagtgatggccttaatatcatactgctgaatgctaaatattaaaaagccaataaagaaattgtaattttttctatctaaccgtcttccataaaccacttgattatttataacatttaccagggtttgaagacgaagctttggggagaatgaaataaatttttcccaatcaaacgctatcttattgttcttcgattttataggaatttgattagtccttttgagaagtgatactagtgttgagtatagtttgtcctgactgctcattgttgatatgatttgattcaatggtatcaatgatttttgttgtttcaaaagggttcacctctatttgtttatcaaagtgtttaatgatattaggctaactacgtccagagtagaataatctaagttggtcgattgtgcgatactttcaaggtttcgattcagaaatgataggtaaaagaaaaaccggtatttttttgataataatgcaaacattccaacagtttcaactcttccatccagtctaccgttactaacttttatcttcaaaagtgaattaattaggctaattacaaatgattctataccgagtgacgaggcatccttgcaagaaataatgtgctcatacattttcatatcaagcaacaagataagtttttgtagtttcaacctttagttatcttactctaaaattgttttcccggtgtaaagctcataatactcacctttattttgcatcaaagcttcgtgatttccttcttcaataattcgaccatcttcaatgactaaaatatcatcggaattgtgaatcgtggacaaccgatgggcaatcacaaacgtggttcgtccgtgcatcaaattatccatcccggattgaacaagcgcttccgttcgagtatcaatacttgaggttgcttcatccataatcatcgttggcggatcggcaattgcagcccgggcaatcgacaagagttggcgttgaccttgtgacaaatcagatcccgagccatcaatgacggtatcataccccttgggcaaattacggataaaactatcggcattggccaatttggcggccgccacaacctcttcattcgttgcgtctaaccgtccgtaatgaatattatcgcgaattgacgcagtaaacaggttggtatcttgtaaaacaattcccatggataaccgcaaactcgctttttgaatctgtttgatatcgatgccgtcataaatgatttgaccactagaaatatcataaaaacgattcagcatattagtgatggtggtcttgccggcacctgtagcaccaacaaaagccatcttttcgccaggtttagcatctagtgaaatatgatgcaacactgttttctttccatcataactaaagctgacatccttaaactcaatgtggcccttaacaggagttaattttacgctcccatcagtttcaactgtcttccatgcccatttatcggttcggtcacttgtttcggtcaaattatgttgcgcatcttcctgaacatataccagcgttgtgtttccagaatcctgttcaactggttcatcaaacaactgaaacattcgttgcgcaccagcgaggcccataatgattgaatttaattgcatggtaatttgcgcaattggttgactgaaagagcgactcaactgtacaaaggctgcaatttcacctaatgtaattggcgtcacatggttgaccgcaaaatagccaccaactacggcaatcaagacgtacaaaatatttccaacgtttcccatgattggaaacagcattgttgatagtccattggccatgctggcatcctgccgcaaatcttcgtttcgggtatcaaaccccgctttggactgatcctcatgagagaatactttgatgactttttggccattcaacatttcttcaatatagccgtcaatatttcccaaagccgtttgttgcttacggaagtactcgctactttttgaacttaactttcgcacaataaaaatactcagcgcaaaaaccaataaactgatgatagtcaaggtggggctcaaggtgatcatagccgttaacgtaaacaccatgttaaaaattgcattaataaacatgggaaaactttgttcaaccatttgccgcaacgtgtcaacatcatttgtgtaacgactcatgacatctccgtagtcgtttgaatcaaaataactcaacggtagttcttgcatgtgagtaaacatttcgtctcgaatccgtttttgcaatttttgacctgtcatgatcatcagttgtgaatatagtaaggttccaatagcacccaataagtagatcgcgcccatcaaaataatcatgtggaataagggggtaaaattaggatgcgcaaccttcagtaatggcgtgatgtaatcatcgattaaccgctgaataaacagcgttcccacaaccgacgcaccggcagaaacaatcacagagaagaaggcaataaacaacgcaaagtgacttttctgcataatgtatttcaacaaacgccataaaatttgccaagccgaaccattcaatttagctctgccagcaactctagttctttgcatgcgattctcctcctttgatttgtgaattgtaaatatcttgataaaccggatcggattccattaattcgtcatgcgtcccaacggcttcaatcttcccatcgtttaacacaacaatacgatcggccccttgcacagatgaaattcgctgcgcaatggttaatttggtcatgtctggtaattcatcgtggaaggcttcttgaatcaaactatctgtgtgcgtatcaaccgcactggtcgaatcatccaaaatcaagattttaggttttttcaacagagcccgcgcaattgtcaggcgttgtttttgaccaccagaaacgttgctcccgccctgttcaatgtacgtatcatagccatctggtaagctctgaataaattcatcggcttgagccaacttagcagctttgatcaactgagcattcgtagcgtgctcatcgccccagtgtaagttgtctgcaatactgccagaaaaaagcacattttgttgaagcaccatggaaacattatcccgcaacgtccgaatgtcgtaatctcgtacatcgcagttgccaacgcgaaccgttccttgattaacatcatacaaacgagggatgagtttgtaccaaagtactcttaccactcccagtttcaccaataatgccaatggtttcaccaggtttgatgtgtaaattaatatctgttaagcggttaacatgatcatcggcatacgcaaaattaacgtggtcgaactcaattgcaccatttttgacagtggtgactggttcttttggattggttaacgtactcttgtaggttaacacttcatcaatccgttgtgccgaggccaaagaaatcgtcatttggttaaacacgttagataaaatatttaagctcattaaaacggacatcgcataggcgattaaactgactaattggcccgtttgcattgagccagcgacaatgcgttttgccccaaaccacgccaaaaacagtaaggtgccatacattataaactgcataatcggactgtttaactgaaggatgcgttctgctttactaaacacctcataaattcgagcggaagcatttgctgctttcttatcttctgtctccgcacgattataggttttcacaacgcgaatgcctcgcaaattttctcgaacaactcggtttaacccgtcatagcgttgataaacttttctaaacaacggacggccaatcgcaataattatggtcaacccaattgccattaatggtacagagacgacaaataccattgccatttcggaatcaaccgtaaacgccatcgtaatcgagaaaatcaacatgaggggtgctcttgcagccgctcgaatcaacatctgaaacgcctgttgaatattcatgatatccgttgtcaaacgcactacaatacttgaagtggagaagtgatccacatcttcaaatgaaaaatcttgaatatggtgatacaagtcatgtcgcaagtttttggcaaatccggtgctagctttactagaataccaacttgccccagctccaccagccaaagaaacaaaagtgccaattaacatgaagccacccaatttttcgatgtaacccaagttccctgggataatgccgttatcaatcatcttggacattaaatatggaataaaggtctcgataaacgtttcaattgcaaccaagacaggtgaaatccaagcgtattttttaaattctctgactgaatgtcccagtcgttttaacatgatttaccacttcctattttttcttcacttaaattggcaatcatttgtttagttactttttgccaaacctcaatatctgccgccgaaacattctgcaatagcttatcttcgaaatcatacgaaccttggataacacttttacgtagtttgagagccctaggagtgagaacgatctgttttaaacgtgcgtccccttctactgattcacgtgtaatatattgcttgtcctcaagctttttcaacaaactagtcactgaagaacggcgaatactgaaatttttttcaacatcgcgttgataaatctctcgttttcctgcattccacaacaaataatgcagaataccgccttgctttcccgtaatgtcattgtttaaaaatgcctcgctaaatcgccgcgatgacatgtttgccaaaacatgtaattgatggttaacacctaaatgattctccatagttttcctcttgttttatattgttagaattctaacaatatacgataacacttactaaaaattcatgcaatcatttgaactattcagttagttcaaaaaggaaatgaaaaaaagccactcatttcattcgatttttcctctcgaatttcatgagtgactgcttaaatactagttataatttaaaatgctgccaaaaaacctatcactaaacgatttcctttaaatccagtaaatcatcaatttgatatgtaggacttacagttgaatgattaggttgcaatgccgggttaaaccatacagaatcaattcctgcgtttgtaccgccttgaatatccgatgttaaagaatcgccaataattagtgaatttttgggcgtaaatcccgcgatggttttagctacaaaatcgaaaaactcaattcgtggtttttgataccccacttcttcagatacaaaaatatgtttaaaataattcaccaagccagaatcatttaagcgttgttgttgcactgttgcaattccgtttgaaacgataaataaattaaattgatcctttaaactattgagaagctcaattgcatgtggttctaattgatgcccctgtgttaagaagtcacgataaattcgttcgtatctgataccatcgacttcttcattgtagtgtgcaaaaagtttggtaaatcttgtattgactaaggtttggcggtccagttgaccgagttcaaaccgttgccacattttctcgttcaaaacgcgaaaataattgacgacatcatcagttaaaggatgttgaatttccttgaataatcctttaagcgcttgatcttcagccgctttaaaatctagtaatgtgtcgtccacatcaaataatagattttgatatttcatgcttctcacctcaatccctcttgaaatgcattataacaaattcatgcccaatttgacgaatttctttgaaaaaaccgacaattcacgttctttttatcctcaactatggtacattaaatgtaaaggaaccaaccacacgaggaggatttgtaatgaatgatttaactaaattagctgaagaaattgtcggttatcagaagaaacatgatttaacagatgcagacgtagcgtttgggactcatttatccgtggaaaagattcacaatatcaaaataaattcatataaaccaacagctgatgatattcagcgtattaataattatatgagagacaacaagtagtgaacggagcagaacggtagtcataaaactctaaggtaatggaggtgggatcgcaatcccgctggaattaggcttagagtttttatgaccattctgcggagttgtcctcagatagtgaacgaagcagaatggtagtcataaaactctaagggtaatggaggtaggatcgcaatccgctggaattatgcttagagtttttatgactgttctgcggagttgtcctcaaaaaagccagcaatgccagtcacctcaatgttatacatttttgaggactgcattcctagcttttttaatttacctaattattcttaccagccgccagatacgcctgataagttccgtcgtcaaagcacaccatcgtcacatttttaacaaatacagctgttttcaaaaacgccaaaatcgtcgaagtggcaatttctgcaccatcacccaacggaaagcgataaacgccagtactaattgaaggaaaagctacactttcacactgattatcttcagccagccgtaaactgtttaaatagctattgtgcaataactccgcttcgtgatggcttccaccatgccaaattggtcctggtgtatgaatcacaaacttagcgggtagtttaaagccaggcgtaatttttgcctcgccagtttgacacccattcaacgcgcgacaggcttccagtaactttggcccggccgcccgatgaattgcgccatcaacacccccaccgcctagtaacgttgtattggcggcattcacgattgcgtcaacgtgcatcttagttatatccccgcgaatcactttgaacgtcatttactcaccttcttacaaaattcccttgtctcgtaaatgattctctaataaaacagcattcaaaaaatcgaatgaaagttcatcgacatcttctatagtaacttctacgccagtttgatccacatacaaatctggatcaatcacatgaaatcggaaagtttcttcaccgagttcagtaatatatcccatttcgcgagcaccggttattagagtaatgcttaaaactcttgaaaatgtttcggcttgtttaattatggcaagaaacaaatcatccgtggcatcaaataaccgttcttcatttaaaacaggctggacaaacgtttgatgctccttttgatactgaacaaatgcattaataacttgtaagtaatctgatgtcaacgtaatactggcaattgtgtccattcgaatcaacgaatagccaccaaactgtcccgccatgtctactaaattgcaaagaacctcttcttcattaactgaattgacagtccccacaaaaaagttgcttgatttagtttcatcgttaattgtaatgagtgtttgctttttttctgccgtttttaacactttgtaaaaactggattcatccgtaatggtcaaacgtgattccggatcttgtgcagcaatcttaggccacatggccgattcaaccgctaattcacgcccagaaaactcaacaatttccgcttctgtatatttaatagtggcatctactcggtgcatcaaattaaatttatccactaatgtcatttcaaaatcattttcacggacagcagccactgtgccttcttgatagttctgtaaatcacttctcgtgagaaccaagaattcccgactattgaatgccgcctcaataacttgtttaattaaatcacttgtttggtcaaattccggaatctgatcggtaatcgtgattaaatgatcagcttcggcaatctggattgtttccatcatattatccagatctggactgtcatattcaacgttatcaattgcatcaaactgaatgtaaaccgcaccatcagcctggcctgtatcatcaaaagtgttgagaataacgccgtctgccccgatgctatttacaaatccggtataaaacgtttcttgagcctttggaaaaacatttgccaagcgttgatcacttttggcaaattccaaatcatataaaatcgaatccacttcgccaccctctttcattctggtgttcttcccattaagtatacgaccaataaaccgaaaagtactagtccaccgagcacaaaaaaggtgccatggttaaaccaatccgatataaagccaaacacaaatgagccgaacggatgcatgctatcaaagcacaagaaccaaatcgaaaatacccgtcctaaataggcaacctctgtgacgttttgaacaatcgtcatcatgcggatccccatccgagctgtataaaatccgtaaactaacgccactgccaacaacaacgcgtagtttacccaaattcccgtgatgattaattccattcctaagataaaagcatcctgataattatttttaattttaggtttttgtttatttaaaactaatgaaaggccgcccaacatgccgccaattgcaaccagcgtcaaaacataactgtatagccgttcatctccgttgtaatagtgatcaacatcatagggcagcagcaaggtaaacccagcgtacattgctgctaaaatggcgtcaaagataatcaaacgaaacacgtcccgattatgacgcacataatttaagcctttcgccaaactatccaaaatcggcatggtttctttggtatggtccatctctggggtataccttaacgcccacgtaaacacgaatgataatagaaaggacagtgcattgataaacagaaaagacctgaaattaatccagtttaacgtcaacaaaaagccaccaaataagggtgccacaatatcagctaacgtaagtcccgtattggaccacgaattaaatatagataatttatcatgccgaataatctctggaataatggccttagcggcaggaaaattgaatgccaaaccaatatcaatcacgcaggtaagtaaaacaagctgataaaaaacgggttcgttgacgtccataattgctgccatgactaaacacgcaaaaaaactcaccgcatcagcaatcagcataattagcttgcgattatatttatcaaccattggtcctgcaaacaaatcaccggccaccaaaataataccaccaattccttgcacaattcctaacagagaagcgtgtccagttgccttcacaatgaaccagtttagcccaaaaataaacagtgcatcgcctaatcgagacacaaacggactaaaaaataatggccaactaaattcctgtttaaatcgctcttccatccagacccacctccccagtagtaagtcactccattctacaagaagaaccctttcagaacaaggcaattaaagagataacgggcaattgagtctatattttgccaaaaaaataataaccaacatcaaatccaaatgtttgttggttactattactcatttactcaaattatcgggcaggattattttttatcccattcttgtcggtaaagtcaataaagcccacgttatcatcaatggcaccaccatctccacttaactgcaaagtacccagatgggtgtttagtttgatcgtcatattttcttccaaatcttctgctgaataatccttaattaataagtcaccaatatttgaatgaataaccatgttatacccagtaatgggcatatccttacccacaacgttaatcgtaaactggacttgcatatgaatcatggcatgctgagaatattcgcccacgccatcttcaaaagtaaacagtaatcgtttagaatcatctaaatgttcccgcaccttactcgccgcggcagtgtcaaattgaatcttcatcattgggcctcctcgtattatatattttgcacccattgtatttgttttctataaattctccaagcaaaattacttggcatgcacgtaaaatgttatatgctaggactatgaatagaaaacagacgaggagatctccaatggaaagatttgagaagtaccatccaattttgacaacccattacacccttgattggcttaccgctaccaaagtaaaagacatttatgccttacgccacgatactgagattgctgctatgagtggtcgccatgttgacgcagacattaatgaaactgtagcctatgtcaataaaactatgcgcaatatcatgcataatgattccctactttggggaatttctgaccgaaaaactgatgagtttttgggaaccttttgcatttggaattttaataaggaaaaaacaactgccgaagtcggttatgagattcttgctgcccagcaaaatcacggtatcatgtctgaagttctccaacacatgagcaactttgcgtttgcggaacttggtttaacgaccctatatgcgatcactggtcaagctaacgtcacatcacaggctgttttgacaaaaaacaaattccgcattaatcctaattatcctggagaaaaagagaccgtcagctttagcttgaccgccccagaaaactaatcattgtaccattctaatttttccaagctctttttaatggcatccaccgattgctgatgattatcgggttggatgtctttttttgtataaactttttttgccggtttttccgatgttgaagcagtgctttgtcctttaggagttttggcgccggtttccatacggtccatcgtctgatttaacaagctatcgacaaatacgtttccttcgttcgtcgcatggcccttcgtccaataataatgtaaatgaggaaattgagctaacagacgatctaattgttgccataactcactattagcaagcggttgaccggaaccacgtctccagccacggcgtttccaccccgcaatccaatgcttttgaatcgcattcagcacatactgggaatccgcaacaatcgcaatatccgcctttgaatcaaggttggcattgatccactccaacgctttaatcagtgccataatttccattcgattattggtcgccccaaattcgccttcagaaccagagtattgctgaccgttagctttcactaaatatgcccatgccgctttgtcctgctttttaacatgaccgccattaacattccctgtattccgtgaaccgccatccgtataaacgacaattgattctgtgggttcatcagggctcctggatgtcgctttagaagttttagttttggatttcggtgttctgattgtttgatcgccattcagccattgctgtgcttcatctttggtggcaaatcccttgtaccttgctccgggaaaaccatcaatcagtgctttagtttctgcccaattcgtgaaaattcccgtttgtttgccttttgcgacggcataaaatttctttttcgttgccattatatttcctcattttagttgatcatttatgtatctaacaatttcattgaaccacattgcaataactggtttcaagttctcagaaaataaaaaattcctctaggataagtttaatacttttgtatcaacttatcttagaggaactgaactcgttatccgaaacggaatcatcagcattcaaaattgctagacctcgaatttcttattagtttgcgtattgtgttaatacttgaccattagttttttcgtttaacttgttaagtgcttctgtgatggttacaccactagctttaatatttggatcgcgtttctcacttgcccagaacaattgtgtttctgtgtccaaagcaattcgataatcacgattactaaagtttccaaatctcattgtaaaaccttctttccttttgtttctcaacaaaggattcaatgagatacgaaatatcaacgattcaaaatgaatatattcttgcagccgcgttcttcccttcaaaaatgatatgtcgtaccaaaattcctttgttcatacttatttaccagttctctaatttcaactggtaaatgaaatgataacacctaaaaggctgtaaacgcaagcaaaatgctctatatttatgtgccaaatttttgtaggtagtgcttttaatcaccagaagcacgattcctgcgggattgcgatcccgtctccatcgtcgttcccgactactactttccgctgagctctaggaccgctcggcaaaacaaaaggcagattataagcacgattcctgcgggattgcgatcccgcctccatcgtacttataatctgccttttatcgttttgcctcgcgcactcttctctatcccttattcagtatatacataaagaagataaacacgaagaacaatccgtacataattggatgcacttctttacctcgttttgccgcaatcattgtaattgggtacgtaataaatccaagcgcaataccatctgaaacactatacgtcaatggcattccaatcaaaattaaaaacgcaggaatcgcaacttccatcttttcccatgacacatgtttcatcgattgcgccatcaatactcccacaataattagcgccggcgccgtcacttgattcgtaaccaccgccaaaagtggtgagaagaacaaacctaatataaataacacacccgttgtcaccgcagttaatccagaacgaccaccaaccgcaattccggccgacgattcaacataagcacccactggagaagttcccaaaacagaacctgccaacattgccgttgaatctgacatcaatgccctacctactcgcggcatcttgttatccttcataaaaccggcttgttgtgccaatcccaccaatgtacctgctgtatcgaagaaagtaactagcaagaacgttaaaacaactacccataactggacagtattgatatcaccaatatgctgaactccaaccatgaaagttggcttcaaacttggagccgccgatacccattgtgttggtgccttaatcaaacctgtgatcaatcccagaatggctgttgctgccattccaataaaaataccaccaggaacgcgacgaaccattaaaatcgccgtcaaaactaatccgaaaattgttaaccaagttgtcgccacctcaagtgatcctaacccaaccactgtcgatttattagctacaattaagcccccatcatgcaaacctataaaggcaatgaataaaccaatcccactagaaattgcatatttcaaatccgctggaattgcattaatgatcatttcacgtaatttaaaaattgtaatcacgataaaaattaaagaagccacaaacacgccagctaaagctatttgccaaggaatcttcattccaatacaaacggaataggcaaagaacgcgttaattcctaatgccggtgcggttgcaattggatatttagcaagcacccccatcaagaaacagcccaaggcactcgctaaagctgttgctgtaaacacagcccctttatccattcctgaagctcctaagacactaggattcacaaataagatatatgccatagaaatgaaagtagtgaaacctgccagaatttcacgttttactgttgtatgtaactgatcaatctgaaaataactattaatcttttctcccatgattgctttctcctttagcattactgattcaaaatcagaaaccaatttcgttcgtgttttgcttccgaaacaacaatatatatcatacaataaaatcgattcaaagtaaaaaacaaactttagaattgtgtaaaaacattatttttcaaaaaatagctttccacagttttacctgaaatacttatcacctaacttaccctcgtatttcttttcataagggtgtataattcatatttatgacagtgtgtcacatcaaaacacacgagatgtaaacattaaaggtggttattaaattatgcaaaagtttttatcggggatcgtcggccttgttgctatctttgcacttgcaggttgtggcaatcaaaaattaactgttggctcctcaaccaaaacaccaagtggcatggttgcggtgattaaaggcaaaactaataaagatgccaaaatcagttatcgggtaaagggacaaacaaagaaatctgttaagaatacagatggtgcttatgtgattgaaattcctgcaactacaaaaacgcagaaagtaacagttacatcacaaaaagggtctgatgttctcaccaaaaacgtcaccatcaagaaaactaaagctttagcaaattacaaatcaatcgcaacaaaatataaccaggctgtgattggcatgtctttatccaagtccacccagaaaaaggctcaggaattagctactgctgaaaagaaagcaaaagcgatttcaacaaaaacaacttctgcggcaaaggctaaagctgaaattgctaaattacccgccagccaacagaaaaaagcccttgccaaacttcaagcacaacaaaaagaaatgctcgcacttcaaaaagaggccaaagaagtccaaacagcaatggctgcttctaaaaagaagaataaagataaattattaccaaccagtttaaacaatggcgtccaaaatgtgattacccagaaaaactatacagttcgcgtaaatcatcaaaataaaaatttaatgggcatcactttgattgttccagttaaagccatgaaacaaaagagtggccaaaaagattttggaacggtctttgctttgttaacctccgaagttggtgctaaaccaaaatcagttatgaaacagttcaagaaagttcaaaaagacgctaaaaacagtaccagcacctctacaacaactcatgtcattaaatcgaatggcgtgaagttccaagttggctactcaactacccatttatatatttacatcactaagtaaaatttccatacttaaaaagccaatcaacaatgagaaaccgaaattctcatgttgattggcttttttgatttgttcattttttaggacaactccgcaagtcagtctttaatatttaagcggggttcccgcaggattgcgactccgcactactccgttttacagttgattttcgttccgaaaatctcctattctccggtcgttgtcgattcttgtggcaaaaacagccgcaagaactcgccctccttcacactctttaccagatttgcacccgtttctccggatccaagtacatgccatctcctggctgcacattaaacgtctggtaaaattcgtcaaaattctttacctgcacattggcccgcaacttcgccggtgcatgcacatcaatcgacaacaacaactgttcatattcctttgttgccttactccgccatacgcgcgcccagttcacaaagaatgcttccaaatctggattctcagtatgttttgccgcctccagcgcacaactcaatccaccatcatcagccacattttcagtcactaccaacttaccattcaccttaccaccagcaaatggaagcccatcaaactcttcaatcatcgcttgtgaacgtttcttaaattctttcatatcagtttccgtccaccagttatgcaaacttccattttcatcaaacaacgcaccgtttggatcaaacgcatgagagatttcatgagccataaccgcaccaattccgccgtagttttcacttgcgctctgtttcaaactatagaatggcgcctgcaaaattgccgctgggaaacagatcaagttgccttctggagaataataagcattaaccgtatcagcactcatttcccatttttctttatcaactggtttgttaaacttgcttaactggtcttcagtgaagacctttgcaaatgcctgtgcgttacctaataacgtaccgccatcctcaaccgaagttgtgtgtaaacgtgtataaacaggttccattttatcaggatagccgacatgaatatccattgcactcaacttcacaaccgctttttcacgggttgccttgctgagccaagtattattttgcagacggtccttataaacacctgtcatcgccacaaccatatcgtgaacatcttgtttagccttttcaccaaagtactttttaccatagtaatcacccacaacctgactaaaggtacggcgagctaaataaaatgcactcttttgttgcttcatggcttctttttggccggataatgcccgatgatacgtaccacttacctggcggaattcttctccaagataaccagctaattggcccacagtattcacaattaaccaatttttgaaggctgggaacgtttcttcatttacaatcttggtgaagttttcaaagaattttggctccgtaacaatcacttgttttggtgtgtcaccaagtaattcagtgatcccatcagcaattttaaactcacccaattctttgttgaattctgcaaaatcaatgggattatacagcttggcaacgtcactcatttcttctgaattctttttaaatggtgccattgaagcatcaaacttctttgcatccgccacaatttgtttggcttcatctgcagacttaccaatcattgtcaataatttctcagccatttgtgtaaagactgctaacaactgtggtcctgcttgattgtctttttcatagtaggttttgtcaggtaaaattaaacttccaccttcagcccataacacgtttaacttagttttaccctggctctttaaatcaggttctaccccaatatcaaagggcactggaaatccgtttaaagtccagtctttaaattgtttgttcacatcagcaaaactagaaattgcttctactttttcaagataaggctttaaaggtgccgcgccatcttgatcacgtttttcaaagttagcagcgacatcataaaacttcaaaaactctttaattaaaggatcattgttagccaattttcctgatttcatatcggcgaaatctgtcattaattttttatctacatcatcaactaagtccatgaatccaccagtagatgagtggtcacttggaatttcagcagtttcgatccattccccatttattgcatcataaaaatcatttcttaattttgtagcatctgccattttatcccatcctttattttcagatagccatagtatagcgcatttttaattttctcacaaaattttaattttacgatacagcattactaatataatcacgcaatgtctgtcccgttaaaccggcgctaatacctatcaataatttaattcttgctttggggccattgagtccctgacaaaatgttacacccattcgttccaaatcaattccgccacctggataatcataaattggttcagcaacaccattatagcaacgtgaaaccatgacaactggaatttgatcatctaaaagttttttgatagctgcaaccgtttctagtggcatatttccagcacccaggccttcaatgacgagcccctttgttgatttctgatctaaacattcaatcaaactagctggcatccctgcataagctttcaacaaatagacattacttaccaaatggtcaatcggtacgaccgtttgttgaattaattcttgaaaataatggattccgcgttttccaactagaccaatggggccgaatgttggtgtccgaaacgtatccacgttagtcgtatgggttttggtcacataacgagcagtgtgaatttcatcattcatcaccactaaaacccctttatccgttgattcatcagcggcagcagtcaaaattgcactttgaaaattataaacgccatctgaaccaatttcgtttgaagatcgcattgcccccgttaaaacaatgggcaagtgatttgggagcgtcaaatctaagaaataggctgtttcttccaaagtatccgttccatgcgtgatgacaattccgtcataaccttctgattcggctttttgtacgcgcttttgaattttcaacatatcagctggggtaatgtgctccgacggtttatttaaaactgattcattagttaattcgatattgtcatcaataaaccggctatctaggagtggattttctttatttgttgaaacctcgcctaaatcattggcagacatcgaaatcgtgcctcccgtatgtaatgctaatatttttttcaagtgttttttcctccttgaactggttggctttatatccctgattctagttgatttcacagtcagttgctacactctattacgatttcaatcttaaaaaatttcttgcgattgaaattcaggagtttacactgtcatttaaagagttaaaataagtttaacatgtacaatcacaggtggcatataatgactcgaaaactacaaaaatggctccttatctaccaagttattattggcggtttggccttattttctagtggaattgcattttcaaccttttttacacacgtcaatcttttatctgggacgctaggcatttttatgaacagtgttttgggtattttctggatcgattatttagttcgcttttctttttctaaaaacaaaaagggattcctgattgataactcgtttgacatgcttggattagtgccactgcacccaatctttgccatctttcgaattgaacgggtcatccgaattattcgctactaccacctgttttggcggttagggctagacggtagatttacaaagacagtacatcgttttttttatgccactggcttcgtttatctactatatgtcagtgtggttatcctagttttaagcgcattgctttattcaatcgttgaaaaaatttcgcttgctaacgcactgtggtgggccatcacaactgcaaccaccgttggctatggcgatgttttcccacatacggcaatcggaaaaatcattgcctccatcttgatgcttggtggtatcggttttattggtttgttaaccagtacaatcaccggcttcttcacctcaaacaacgccaatatggaaaacactgatttgacgctgcttctgcaaaaaattgatgacttatccgatcaggtttcgcaactgcaaaaagaagtttctaaaagcaaaaagaaatcacatcgaaaaaagaaatcgtaactaaaagaccagtaacctttcacaaaatgaaaagggcactggcttttttgattattctaatttacaaatttaacagctgtcccataagcagcaactgtttccatgtcttgaccaattgaatctgaatcaaaccgcatcataaccactgcgtcggcacccatttcttctgcattatttctcaaccgcgaaatggcggtatcccgtgcttcagacaacaattctgaataagacttaatctcaccaccaacaatgttcttcaatccggcaccgatatttttaattacattttttgactgagtcgtcaatccaaaaacttcaccaataatttcataacgttgacccggaacattttcagtcgtggtcactaaaattctgtctgccatctgtgtgtctcctaactttgccctagtttagttgaaacttacttgccatccatattatagcatgaaagcgtgcccgtttagtgagctctaggaccgctcgacaagtcaaaaggcagattacaagcatgattcccgcgggattgcgatcccgcatacatcgccatcttgccctgcttttttccgctggactctaggaccgctcgacaaaacaaatagcaaagtataagcacgattactgcggggttgctccccgcatacatcgccgcccttgccctgcttttttccgctgaactctaggaccgctcgacaagtcaaaaggcagattataagcatgattcccgcgggattgcgatcccgcatacatcgccgtcttgccctgcttttttccgctgagctctaggaccgctcgacaagtcaaaaggcagattataagcatgattcccgcgggattgcgatcccgcatacatcatgcttataatctgccttttaccgacttgtctcgcgcactttactcttcactgcccaaataattacccacaccagcagccaacatcgctcctaccaatggtgccaccaaatacaaccagtaatgagtcatcgctgaaccacccgcaaacaacgccggaccaaaacttcgtgccgggttcaatgatcctcccgtcaaattcaacgccactataatcatcaacgccaatgtaattccaataatcaatcccgcaaagtttgcattgccccactttttacttgtgaccaacacaataaccaacacaaacaggaatgttaccaacgtttccgtaataaacgcaccacccaccgaaatattcggaaagtccgtttgtcccaaattctttgtcgataatcctaattcatgaactaaatcaaacacaattgcagatgccaaaattgcgccaacaaactgcgaaatcacatagcccacaaaatccttgattcctaatcgatgatttaacaacattgccaatgagctcagctaaatattttctcatatttccatctcccgttacattacgaataatgaatactttctatctaacaaaaattatagattaatttttcaaaataaacaatcttgaactattaaaaaccggtaataaaatttaactatcctttaaaatcggacaaaacgctcgtttacatagcgtatctttcttgttgttatggtaaaatataactaatatatttttagggggaatgaccatgagccaagtcgatgtcaagttaatcacagaaccaaccgcaaaagaatttttaaccgattataaagaacaaaagcgaaataataatgttcccgagctcaaaagccaaggccattttattctacccgactacaaactgaccagacaacgcaaagcttttaagatcatgaaacacacctatctgacaaagcactacaaatcatatgttgctttcgattccgacaatggccacaccctgtggatgaaaaactttgccagtttaactgaagctgttttttggcttgaaactggactggatattggtgatacagacactcgttcaacctacaaagagtggaaggtaaagcatgaagacgccattgaagatttaaaaaaccaattgcgtgagctgaagaagaaacgtacgcaacaaattcctttagacagtgctaattaagcataaaattgcaattattaagaattcacctattttttgagggtgaattttttttgcaacataatttaaaattttatcaaatattacaaaagtctttgacttattgaggtcactttaattgcattgacactattaagttacttccctgtaacataaattaagtatcatgaacgttatacaattcgcacgggggtaatgtctaacatgaaatacatagtaagaatattcgcaattctaagcattttcatcggaatcactgccgttcatgcaactcaagcaaacgcggctacaacatttcgtgtagtttctactaaaaacgtcacggtcaaatcttatgttcgtaccagcgctaagggttctctttacaatttgaatggtaaactaccttatgttagttttaaaaccgctcatcaattaaaaaactatccaagaactactttccgagttacgaagtcgcgtattattcttagaaacggcgtaaaaacacaatactattacgccatcagtactaatggcaaggcagctggctgggtatggcatggttatttgaagctcaaacctggtaccgcaacttatgccaagatttatagtcaagctcgtaaacaattaggaaaacgttacgtttacggagcagttggtcctaaatattttgactgttccggcttatcaaagtacgtttacaagaaagccatcaataagacccttccaagaacagctcagtcacaatacaataaatacaaaaaggcttcaacgagcactcgtaagaaaggcgatctcgtcttctttggaggaagtaagagaagcatctctcatgtaggtatctatgttggtaacggtaaaatgattgatgctcaaaatcgcggtgtcatcactgaaaaagttgcttcaccatggtggcattgtgttggatattgtcgacctgcaacattaagctaaactttaataatggatatagtagtgcttaggtgctactatttttttgtgaatttattctagtattcatatttgtatacctcacatgaaaagtcctgtacaatgtaattatcataaatgactaggaggttatttctaatgacaactgaaaacaaagtactaagttccctttcctatttgagcattttatttttgcctgttttgtttccattaattgtttggatcctcactagtgatcgcccacaaactcgtcattatgcagccaatgcgctactcgttcatctgttccctgctatttttctatttgcaattttaatcattgcaggcattcagggagcaatttcaaatgaccccacttcggttggctggcttctcatgattttattgggcatatttgccattgtatcaattggatttttcatttacagcatctataaaggaattaaaattcttgtaaattaactgaataaactgtcactaaagccggtgtgttaatctttaactcccctggctttttaattttcaaaaaaagttgttttaaatgttgcaagcggttacatgatgtgctaatataataagtgaggaaagggaatgaaagatttccgattaactcaaacttctcaaagcgctttaggtcagtcgatagttgccgatggtgatctaacgtagaagcgcaacttggaactatgtggtgaaggcttatcaatcatgggcatcgtgtaaaggttttgcttgttgaaaaacatgtgagcagtttacagtcagattgattatgtacgttagctcaaaagttttgatgtgcaactcaggagagtacgataatgataccttgagttatgagcatcggtttccaaggttttgatgttgaagaacattgtgagcggataaagtagttagtacttggctcaaaagcctagatgtgcgattgataggtgcgtagttttctggtaacgaagcaactaaatatgataaagatcttggttaatatgtaattagacttcggtttaagcaggtgttgccaatgacaagagtaaacgtaagttagagataacttacaggttccgattattcaaagaattacagtagttagtaagtaacaagtatctagtacgtttgcggaggtatttaggatagtaaaactaatttcttccaaaaccgtctttaatcaccgttagcctgtattttgtgtatgtatcacgtgggattcaaacttacgctgatcacaattagcagattttgataacaacgatcacaggtaggtcaggttcacgacggtagaacaattgaacaatgaaggtgtaaagttattaacaaatttgatattgaagatgttaatcgcgaaaccctttcctcgtaggtagactttaagctttgagaagaacttaaagtctacttttttgtgtagtgagtgaagaaaaagtgagcggaacaaggcgtctagactcatagttataagtgagatggaggcgggatcgcaatcccgcaggaatcttgcttatagctatgagtctgccttgtggagctgtcctaaaatagtgagcggattgtggcattttgcctaatcgagataaacgtgccggtcgagcgatcgtgatcgcgcggttaggcatgattatctcgattgggctgccacaaggagctgtcctaaaaagtgagcggattgcagtgtccttagttacccctaatccaaaacaaacaccccacaaaaaaacaggccccaccctcaaaaagagcgtaacctatttcatgaaatccaaacatcaatcgtcaacatttgaatacataatatttccaaaactaaatttaatattttctttttctaacgactccaaacaaagctaaagtagccatgacaagcaatccaataatgccaacatttctaccagcaacagtatttgcctcattggtttgtggtaattctttattagccgaaacagaattctttttcgtagaaccagaagcggattgaccattcactgaaggattagaattaactaccttaccactgtcattttgacctaaaccgtttccttgattgttaggttggttttgaccagagtttgatcctccgttgccatttgaaccaccattatcaccggggtttcctggagttcctggattgccaccattgtcagccttcacaactaccacacctgttccagatacggaaagtcctataactggatcagtataagtgaaggtataggtcccacgattgccagcaatattcgtgtcgaaattgcttgggcccttgataactaagctaccgtttgcaattgcttatgcataacttaaagttgtgcctgtagaagaaacaatcgaattgaaaagattttccggtttaaaactagatcccttttcaatcgtaatctgtggcttaatattaatggttggttttacagcatcatacttataagtcaacttgatactatagtctttaccaaccccattttcagatacagtcgttttatcaatatacgttaaaactgtttgccaatcagatgccgtccactcacttggatctttggttacccctgcagcagatgcaaaatcagtcaaactaccagtatgtgtaccatcctcgttagtcaaggtataactactattagtgtagttcacttgataacctgaaatagttttcggtgcggcaaagctatagttttcacccgctttaagttctgtagtatctgcattggcaattgccttgcctgttgtatcttgatattcagttgtttgattaaacgttccttgaggcactacagaatcatacttataagttatggtaatactataattttccccaacactattcacttttattgtattcagaaaagcgattacttttttccaatcagaagtcgtccagttacttggatcaccaactactccggcggcagatgcaaaatcggtgagctttccagtattcgtgccatcttcgttgattaaagtataactacttttagcatagttcacttggtaccccttaatttctttaggcacactaaaactgtaattgtctcccgttttaagacttgtgctaattgaatcagcaatcctttcgccatttatgtcttgatactccgtcgtctgattaaacgcattttgggatgcttctcgagttgattttttttcatttttacttacttgtgtcgcgtttgatgaacttacattatttttagaagacactgctacattagttgtctccgcatttacttgattgggtgtcacacccatccctaaaattcctgctgaaaacagtagcgtccccgcgagtaaagcatatttccgattttgtttcactttattattggtcattttgttctcctttcaaacatcatttacatcatcattctccatctgcattctaacatcttaccggtaatattgacagcacttacattgtattatttactattaagaattttcaatagaataatcaagaaaacccgctttaaatgcatacatttgtcggtatttgtccgctatatctttattctttagttattcaaaatcatacaattattgtgttcctcttgtgggctcaaaattcgcttaaatcccttaaattttaggcaaaaaaatccaggaagaaattagattcatttctttccggatttaatgttaactttatttcaaccaaacaaagttactgtctaattgtatttttaatctctttccgcttcttctttgctgaaacggttgttgaataatggactaactggtttgttttcgtgaattaaacgaatagcttcaccaattaatggaccaacagagatttgagtaatttttgaaattttcttttcttctggtaaattaatcgaatcagtcacaatcaattgcttgattggtgaattagcaattctttgaatagctggacctgataaaacaggatgtgtacaacttgcgtaaacctcagttgcaccagcgtccattaaggcttgtgcgccaagggtgatggttccagcagtatcgatcatgtcatcaatcatgatacaacgtttgcccttcacttcaccaataatgttcatgacttccgcaacatttgcacgaggccgccgtttgtcaatgatcgcaattggagccttcaagaactcagccaacttacgagctctggtcacaccaccatgatctggtgaaaccacaacggaatctttatccaaatgatgttcaataaagtagtcagccaacaatggtgcgcccatcaagtgatccattggaatgtcaaagaatccttgaatttgagcggcatgcaaatcaagcgcaataatacgtgttgcaccagctttttcaatcatatctgctactaacttagcagtaattggttcacgtgaacgcgccttacgatcctgacgtgcatagccataatatggaataaccacattaatagtttgagcacttgctcgtcttagtgcatcgatcataataagaagttccatcaaattatcatttacgggtgctgaagtggactgaataatgtacacttgatccccacgaatactttcttcaatgttaattctaatttcaccatcgctaaaacgatcaacagacgtcttacctagcttaacaccaactgcttcagcaattttttctgctaaaggcttgtttgaattcaaagcaaagatcttcagctttggatcagaatattgtccagacatgaaatcctccaataatgatttttaagaatctgtttgattaccactatatataataattcatttgagctaccaaaagcaagcgtatttcccgtacaaacaggaaatactttaacttgtcttcgaaacttaacaccaaacttttaatccttattttcagcctgttttgcttcttcttgttttatcgcatcataaacaggcaacttcttgaagtatccaggttttgtcgtttgacgagaacgcgcaattcccatatcatacttcgccaaatcatctgtaattgtcgaaccggcagccacatacgaatagtcagccattttaactggagcaataatatttgaattactcccgataaacgcatggtcaccaataaccgaggtgtgtttattaatgccatcataattcacaaagaccacgccacaaccaatattgatgtcagttcccaaaacggcgtttccgacataagtcaaatgacccactttagtccgagcacccagtttggcttttttaatttcgcagaagtttccaatgtgcacaccttcaccaatttcagcttccggacgcaaatgactgttaggtccaatatcgctgtcatcatgcataatagattcttcgattgtagaagaagtgacatgtacacgatcaccaatcttagaagatacaatcttggaatttgcaccaatgacacagtcagaaccaatgaccgtttttccagatatcgaaacgcctggttctacaatcgtatcggatccaattttgacatccacatcaatgtaagtattgtcaggatcaattaacgtgaccccattagccatatgctgatcattaatgcgttcttgcatgattttagtggcatttgccaaggccttacgatcattcacacccatggattcggaaaagtctttcatctcataagcggccacaatttcgccttgggacttcataatttcaataacgtctggcaaatagtattcaccttgtgcgttattatttttcacttgatgtaacgcagcaaacaactttttgttgtcaaaacagtaaacaccagtattgatttcgtgaattgcagcttcttcccgagtggcatctttttcttccacaattttagaaacaacccccacattgttgcgcacaattcgaccataagaaaatggattgtcagcatcagcggtcaaaatggtcgctgcagcccctttttctttatgatattcaaacaaatcttcaaaagtgctagcacgaaaaagtggcgtgtcaccactgacaaccatggtcatcccatctttatcgcccaaaatagattccgcctgcaaaacagcatgaccagttcctaattgttgttcttgataggcatattcagttcgtttgccaagttcatcttcgacccgttcagcaccgtgaccaaccactgtgacgacctgatccatgtttgtcttttcaacttgggtcaacacgtgatctaccattgatttcccacaaacgcgatgtaaaaccttgtataacttcgacttcatccgggttccttgaccggctgctagaataactgtgtatttaccactcatttgaatttctccttgcttttttaataaaaattcttttgatttaatcaaaaacttttgctaaataattaccgggttgaatttgaatttcggcgcgactcgcatccacattcaacaatgaagtgacgtcatcgatcatccgttgtccattgaaattaccttgggcaaaaacggttgtgccaattaactcagcttcaaattcagtgatcagcgcctgcatccctttgagcgtgccgccacctttcatataatcatccacaactaaaactcgtgttccggctttcaaactccgtttagagagttccattttcttaatctgagctgaagatccggaaacatagttcacactgattgtggaaccctctgtaattttagaatcatggcgtacaataataaagggcacacctaaataatccgcgacactctgggcaattggaattcctttcgtttctacggtcataatggcatccacttttttctgtgcgtattcatttgcgattaaccgaccaacttttttcaaaaccactggatcgcttaataagtcagacatatacaaatagccacctggtaaaatccgatcagctgtagaaagctgttgaattaaatcatcaatgatcgtttttgcttcatttttttgaattgttggaataaacaaagccccgcctgccgcaccggggattgtttctaaaattccagttccccgatttgaaaaggtccgtttaataattgccatgtcttcgctaatagaagatttagcagaatcgtaacgttcggcaaaaaaccgaagtgttactaacgtgtggggccgctctaaaaagtatctagtcatatcaatcaaacgatcacttcttcggacactcaccgctatcaactccattctatttattaagttactttaccttcgatcatagcataaacgttcgtgttttgctcaaaaaacggaaaagttttatcatctttttgatttctttctctagagtaatcgcatcgtgttcatatttttcgtaaagtatcactcaactaaaaaattgatcgtagcgagtcatgaaaatggactcagtagtgaaattactgttggtgctttagcacttacagtaaggtcaatattcaagccaacagttggcttgaatttgtgcccactacgctccagtccatttttttttagactcgctacgatcaatttttaattttatttatccatttttaattcgattccaagtcaaagcaccaaagtagatcacacactcgatcatcgcgatgaagaaactgactggccaattggtaacatagcctaaatacaagcctagccaaacgcctaacaacgcagccccaattgaaaacaccatcatgccactcactgtcctcgtgaaatactttgcactcgaagccggtaacgttaaaagcacgaaaatcagtagtgaacccacaatctgtgcggcaacactcacactcaacgctaaaattaccaaaaagataattgagattgcctgcgtattcactcctttaacttgagcacccacgtgatcaaatgaatcaaaccgcaagtctcgatacacgataaatataatcaccagtacggcaatcgacaaccacaaaatctggtccacttccgattgactaatcccaatcatgcttccaaacagaatactggttgcatcgctggcatttttatttgccaaagacaagaataaaattcccgatcctaagaaaagactagatatcgcactaatcgaggcctcacgccgagaagacttggaactcatttggccaatcaagacggaactcacaattgtaaaaagtaacataccatttaatggtggccaactcataaagattccaaatgaagcacctgaaaaaccaatttctgacaacatgtgactcagaaacgacatatttcggccgataacatacacgccaatgataccgctgatcacggcaatcatggttcctgctatgtaggcatggcgcataaatgcaaaactaagcatgttcagcctcctctaaatcagattctttgaactcactaattgggccactcagataactaccatgacgcatcaacaagtagtcatgggcgtatttctgtgctagctcaatatcatgggtgataaacaacaccgtcacaccttgttgctcattaaattctttcaccaaatccaaaagttcaaacttacggacattgtccaaactagctgtggactcatccaagataaggagatccggattgttaatcaaggcttgtgccaaatacgctttctgtttttccccacctgaagcctcaccaagaggtgtattttgaatggattccaaattagtttgttcaatgattttatctaatttttgccgttcttttttggacgaccacggcatatgactatcatgcaaattcaggccaataaaatcccgaatagataatggatactcctcatcaatatttcgaaactgagggacataaccaattttcatccgtttgaatacgggacgatactcgattttgccatgttgtggtgtcagttcatgcaaaatcacccgcacaagtgtggttttgcccactccattttgaccaacaacactcaaaaaatctccttgattcaattgagcagaaagatcattcaaaactaagtgatctggaaacgacacagttaagtttttgatatttaaaacgggctcactcattgcaatctttccttcttttggattttggccacttggtcatattgctcagtcatccagtcaagatatgttttgccagatggctgagtttcggtaatgtttaaaaccgggacatgatgcttatacgccagtttgaccatgtttttcacaattggatctgatgcttgcggattattaacgaaaaacgcaatcttatgtttcttaatatcgttttgcatctggcggatatcctgtgtagttggatcagaaccattttcaaccgccaacgcaaaatgagaattattaactttatagcccagttttgccaacgcatagtcgaaaactggttcactcacatcgactcgactcttcaatcgattcttcttaagctgggcaatttgtttgtcaattctattaagtgacttaatgtaacgagcggcatttttttcgaattgtttgcgatgtttcggatcttttttcgcaaaaactttagctaatttttgggctaacttaggcatggtttgatggttataccacacatgcggattgtctgttaacttctttcccatcacagttccaccaacattaattttagtagctcccgattcggaatccgattcaatcaaccgttgcatccaactgtcatagcccaaaccgttatagacaatgacgtcggctttagccactgatttagccgtattcgtagtcggctcgaaatcatgcggatccacattaggtccattgataatttcgtccacagtcccgtatttgcccacaaccgccttagccgtttcaccataaaaattcagggaagtcacaatatgaagtttattcgatttgtttttacttggcgcgcagccccccagaactagtaaacacattccagtgagaactgctagcacgtatagccacttatgtttcaatataaattccccgtttcttaaaaagtaatcattactatttagcaactttttatattatagcaaacgtacccggttttaagcaagcttgctgaataatctttattcttttgaaagttaacttaagacagtttgaaaactgctaaaatttcatttttagttttagccgtagatctgtctataccactgccaaatatgctaaaattaaggtattaattaaccacggaggttacgatgaaatcacaatttgtgcttgataattcttcaaaggctgccttgtataatctgtatctttacgcattcaataaacctgatagtgactttcgcaaaaaattctggtccacacggtttgaccacggaattccgtatgggatattcgaagatgatgaactggttagtgacctcttcagcatgccgtttaaagtgaatcttcacggtaatccccttctcatgaatgggattaccgatgtgatgagtgtccctgaatattccggtaaaggggctgccgggactttaatgaaagccgcccttcatgatatgtataaaaataatgtggtcctttcctacttagcacctttctcgtttgcttactatcgtaagtttggctacgaacaagtttttgatcatcaattatatcggctttctggtgacaaacttcccagggtaaaacccagcccagttggtcatgtgcgccggactagtttaaagaatgcaatttctgtcattaaaggagcttatcttgagtcacccctcagccagaacgggggtctcattcgtgctgactggtggtggcaatatttaaccgaaaagcatcccgaatggcaagtcgcatactatcaagatgcccagcaagctgttactggctatctcatttatacccgttcggcagatgagttccacgtacaggaatttgtgcatcttacccccgctagttatcagtcactactgagctttgtattcaaacatggggctggctatcaaacatacacatttgaaaatgctaatccaaattaccaaggcgacttactagctgatccgtatgctttagaagttaaaacgcatccgtacatgatgggccgcattgttaacttacaggcattcttggcggtatatccgtttgaaaaatccgattttaaacccttgagttttaacattgaagatgaagtgatccagcaaaaccaagggagctggaccatctcggctactgatggcaaaacgggaattgagcatgattctgagaaaaaagctgatgtgccaacagtgacaattcaacaatttaccaaggctacttttggttatcgcaccttaagctctcaacaagcctttggtcaatttgaagctagtccacaggtacttgctaaattagatcaattatttgtcaccccaaagcctgttttggcagattatttctaaaaagagtgggaaaaaggtgttgtgacttctccctcgatttcgactattaaagttcagaaacagaaagagactgggatttttcccagtctctttgttttataataatgctcgattaatttgactattttaaaatgctccgaaaagcaacgctaatcctaaaaggaatatgataattccaaagaacaagccaaaccaaagtccaaaccctataaatacattagtgtttttcccggccgtttttttaaaacttctaaatgcctgcctaaaactatagaattgccatccagctattgccaacgctaaaattccacacaatctttctatcaacatatcaaatgcccccattagtatttcttcgagcctttactctctagaaatttttagttgtaaacatcctttattcataagaaatagattcttgaatactctgttttcgtttgccggtaactaagaacaatgctacgagaacaagaaaaatcaccacaatccaagtggcaatccaatcgacaccatctggagaagtcatcaataaattgccattcgtatttgagaaagcaaaaatatctaagaagaaatgactaaccatggtaactgcgatactttgcgtgtaaagatacgtcgctgaaaggatcatccctccgccagctgcaaacaaaatttgattcagagttgcgctaagggattgacccgcgagtaaatttgaagaatgccacagaccaaataacaatccattaatcaaaactacccagacatactgattctttacatgactgaaagccttcaagcttaaaaacaagactgcaaaacgaaacgcccattcttcgcagactgtttctaacgcgcttaaaacgatttttaggttaaaatggcctaacgaaaaatcgtaactggtaaaaatattcgaaagcttatcgcctgaaccaaagccattccaaacaatcagtgccagtaaaaccacaattgcaaaactcactactaaccagtttgccgagcgtgatagtcgccaacccggtagtttgaatccccatagatacatcaaaaacccaactgtaataataaacgcaaacgcattaacaaccccactcatatcaattgtttgtaggattgaaccaatttctttcggtcgggtataccctagtggccgtttttgatccattatcaatggctttttaaattagggcctagtacttttggaatggaaatactttccaacaccaaaaattctagagccgattatttttgctaagcgagatttctatatataatggaattataaatttactgttggaggtttttatgactgatttatttgcagatgggactatctctatccatggagctcaagaaaataacttaaaggatgtcagtttagatattcctaagcataaaacgactgtatttgctggtctttctgggtctggtaaatcctctttagtttttgatacattagccgctgtttcccgacgtgaattgaatgaaacttttcctagtttcacccaacaatatttgcctaaatacggtcaacctgaagtgaaccgaatcgacaacttaccagtggcaattgtggttgaacagaagcctattggtcgtaattctcgatctactctggcaacctacaccggcatctattccgtcttacgtttgatgttttctcgaattggacagccttgggttgggtattctgaatggttttcctttaacctacctcagggaatgtgtccaaaatgtcagggattaggctttgttgacgacatagatgaacgtcaattaattgatcctaataaatcactcaatgaaggtgcaatgacttttgccggttttcaaccgggaacttggcgttggaaggaatatggcaacagtggattatttgatttagacaaaaaaattaaagactacaccgatgaagaatatgatttattcatgcacgctccgcaacaaaaattaaaaaatccaccggcaaattggggccgtacggcattatatgaaggactagttccacgtatgcttcgctctgttattcatagtgcctcaggtcgtcatcatgaagctgccttatcaaagattgtcactcgaaaaccttgcccagtatgtcatggaacacgtctgaacaaaaaggctctaactggtaaaattgctggcaaaaatattgcagaagtcagcgatatggatttagtaagtgtcctaaaatttttggataatatctcggaccccaaggctaaaacaatggtgcgtgaactacatagtaaaattcaagctttggtcgacatcggtttaggttatctttcccttggccgtggaactgatactctatctggtggagaagctcaacgaattaaaattgccaaatatttgacgagttccctatccgatttagtttacgtactcgatgaaccaagtgtaggactccatcctcacgatattaaattaattacccaatccttaaaaaagctcaaggaacatggcaataccattatcctagttgatcacaaccctgccattatttcgacagcagattatgtcgtggaaatgggaccacaagccggcaaaaatggtggtcaagtaactttcactggtacctacgacgaactattacggtcagatacgattacgggtaaaatgttacgagaaaaaatcactttcccaaagcctcgtgaacctcaatcttggctaaatgttaatcatgtaacttctcataatttaaaagacgtatctaccagaatccctcaaggtgtaatgaccgtgatatctggaccagcaggttctggaaaaagtactttagtccaagctttcaaacaacaagtttctgatcaagactatattgatttgagtcaggattctgtaggtttgaatattcgttctacacctgcaacttacttgaacattttaaatcctctacgaaagcttttcagtaaagccaacaatggcgtttcaacacaactatttagttataacggtaaaggtgcttgtccccgttgcaaaggtaaaggtgtaatgatcaccgagatggcattcatggatccaatcgttcaagaatgtgagttgtgtcatgggaaacgttatagccaagaagcactacaatacacttatcatggcaaagatatttctgaggttctaaatctttctatcaacgacactttagagtttttcaaagatgtgccagatatctacaaaaaggttagtctactccaccaagttggacttggttatttgaatcttagccagtcgatgaccactttatctggtggtgaagtgcaacgtgttaagttagcaatggaattgaatcataccggccgaatctatttcttagatgaaccaacaaccggattgcacttacaggatactcaacaattgatcgatttatttgaaggattggttgataagggcaatacattaattctgattgaacataatctgaaattaatttcacgagccgattggttagtcgatatgggacccgatgctggtaaattcggcggtcaagtttgttttgaaggtcatccaaaagatagcctaaacgataaaaactctcggactggtgctgcattagcagctataatttcttaaaagattcaaaaagatcacctcacttcttactgattctttaattttatatttggttaaagagctaggctgcctgtataatagatccatattcgatctcaaggacccacatcctaaatctaactgttcactacgtgttgttgggccagtttgacactcggaatgtatatttcactgatgttgacgacctcaacctcaatttaagtatagtaaaagaggtatcaagattgtcgtcacaatcttgatacctcttactttaggatgtttgacagagacccatttttatcatatccttttttcaaaaaaaaatgaccgcaagcaatgagttccattgcttgtggtcacgcctaatcgaattagtaacgatccacaaaaactttattcatgagtaattgtagcccaattcctttctaatgtaaacgttttatttagtttcctttttgtatttcatctctcatcccatgtttggcacgcatttgcagcccataaataaattaatttttttgctgagaaactatctatacaactaataatccagtagttaatatgatcattaataaacgagtacctttaattctgatcatttcaaacgccggactaacttggttttagtcttctgttttttgacggttatgaataagttgcatagtttgtcgggcaatgggttgtgcaatcaatagttcaacagctagagcaattgcaaagtttcggggccatttcacaaaaaattgctgaaatggtgtccaactaatttgttggctgccaatccaagttcccaaaactgtcataaatatcgaaattaataaaacagagcacaaaccattaatcaccatgtgcgccaaaaaactgtcttcacgatcgacaattctttctgtcagccatccggcaggctgttgtgtcaaaagcacgatagccaaaaccgttatccacattaatggaataatggctaaaacttggtgccaagtttgccagctaaatccaatctcaaaccccgtaataacgggggcaataatatttactgagattatggaaattaaaaacataaataaaactgtttccttcttgttctgtggtaatttcattctaaataacatatagttcctccttttttttaaacgtgcaagttttcccaacagagcgcaaaaaatcagcgcatgtttttataaaaaaacatacgctgatcaattatacgcagtatgggttccatctcatctattgtaacaaactcacttaaaaagcataagcgttttctgaaaactcaggttgatttacacaaattatctcaaaaatttccgaccaatcataaccatttcagcattagactccaccatgtcatccttatcccactcaacaatcatctgggttaacccgcctgctacaaacgctatccacattttggaagctcggtcacgaattttcaaaacgtctttgtccactagatcagtaatataaaattgaagtttatctaaaataatccccactaagtcagctttgattaaaatattaacagtgccacgatgtcgccgaatcactgtaaaaaaggcatctaaaaaagctgtcatatcatgcgtattcataacttgaaggtaactaaaaaactcttggaacacttcatcgaattgatattccaagatctgttgttttgatttaaaactccgataataggacatgcgcgaaacagatgcttgtttacaaatatcgctaactgtcacttcatcaactgagtgggtcttcattaattcaaataaggccagcacaatcttttgtttggtactcgaacgctttgccatgatttccctctttactttactctttctaatatcataccattttcagaaaatttacgtaattcacacgttttatagatcatctagttttcaaaaccagatgattagtatataatatctagttgaacggaggacgacctaatgaaaccaacttttaaatcgaaaaatatcatcgacatccgtcactcacagctacttaatgaaatttggagcgccattacccacggaattggattttttttgagtattgccggaaccattttattgcttattaaggctattggacttggaaaaccactagatatagtcgcctatactatctatggtcttagtcttttagttttattcttctcttctactatgtttcatagcctctatttcacgaaagctagtcacgtcttccaaatattagatcatgacagcattaattttttaattgcaggaacctacacaccttattgtctccttgccattcgcggccgtctaggaatcagtttatgcatcgtcatttggtttctggcaatcgccggaattgtctttcaattctttgcggttggtaagttcaaaaaaattgaaacccttatttacgtgttaatgggctggctttgtctagttggcgccaaacaactctatgccagtttaggcttaattggcattagtctgcttgttgccggcggcgttgcattttcattgggtggcctgatttacaacatcccccatgtaaaatatgtacacgtctggtggcatattctggttttagtgggcgcttcattaatgtatttctccattttgctgtatatttagagtaacaacaaacacggaggtagctatgaaacgaccaaacaatcaatttatgctctttcaatatcttttaggctacgcagtaatggcctattttctctataaatttgggtttccggtctcattgatcataattttagttgtcgtcagtttgagcttagccggtggttcaatgtacctttctcgccatttcagctggacaaatttgggtctgatgcttcttctaatcgccatcggaactgcgatcttattcttgattttcagccgttactattagcttattatttcataaaagaaagcgattgcaaagcttgataagtgatgctacactgatggcaataatacagttaacccagagtaggttgtttatgtttggattgtaattttgaacgaagacgattgtgatgaatgcagatcttttaattggtgtagtaggtatcttaattggtttgtttcaattttacaatgtttacaaaagttggcaaacattgcgtgtgagcatgaatggtcatacttctctattcatgccatttgcaatttggtacagtgtattcttcggattaattttcattggcctgggtattgctgcattgttataacgactttaagtaattgattacttaaacgcgttaaaaaaggagggcccccatttttggtgactctctttttagtttaatggcctaacaagatacacttccggacaaaagcccttcagactgtttacaaggtgttgagcccggctttccttgcgacaaatgccaaaaacagttggtcctgtgccactcatttgcgcaacatcggcaccataccttagcatgcggtcttttaattgtaaaatctgtgggtgcatctgccctgttaccggttcaagcacgtttcctgcatttttgcagattgccgaaaaatcattttgtttaattgcttccaacattccgtcaatttttaaatgacctaagcttttatgatcaatctttcgtaaaatcttaggcgttgaaacgctcagtttaggctttgcaatgacaaaatacattgccggtaattgccgtagcaacgccactttttcacccttaccataaacatgggctgtttgactaaacacacaataaggcacgtctgaatcaatttgaaggcctaattcagccaattgagcctttgggatacctaggttccacaaattattcaatccacgcaacacggcagcagcatccgaagaaccaccacccatcccagcagcaaccgggatattttttttgattcgaatctttgcaccagcctgaacatgaaactcttgttgtaatagttttgcagcttgatacgctaaattacggctatcattgggcaaaaatcccgtgtctgtatggacactaatggcgcgtttaccaggcttggtttcaatctttacataatcggcaagatctaccgatgtcatcaccatattccattcttgaagcccatccgagtgattatagggtgtgtctaagaacaagttcagcttggccggggctttttccgttgtctccatgcaatcacctagtttactaatccagtattttatcacaattatacttaaaaactgggtaaagtaccagctctggagaaaaagcttcataactcttatcctaaacatcattttatgtgcaaaaatgataaatttaggcaaaataaaaagacctttgcggcccgattatttttattctccgaatgcaatttcgatgttcttcgttagaatatcggtatagctatatgatacccgctcaaaagaattttcgtcttgatctaaatcaacaacgaaaacagctggatatgtcttatgaagaattccatggcgtttcgtaatcttcttacgacctgcttgggcaactaccatcatttcttctccaaccttattgtctagcttcgacttaattgtggctagtgtgtttggcattggcttcaccttcccatgtgaaacattgtaacatagtttcacaaaaagtgcaaattataccacaacgtttgatagcctgcaaccggttttttataaaattaggattacatcgtgtttacctcaactacgtgggcatgctaatatatattccgtttactaatttttccgaggacggctcagcaagtcaaagggcagaacctaagtatgactcctgcgggattgcgatcccgcctccgtcacatgctgctccttttccctattttttgaggacggctcgacaaaacaagaggcaatatctaagtacgcctactgcggggcttcccccgcttacggcgcactgcactttttcctttttttctgaggacggctcagcaagtcaaagggcagaacctaagtatgactcccgcgggattgcgatcccgcctccgtcacacttaggttctgccctttaccgacttgcttcgcccactattttagttcattcgtcaaccttacaaaatcgtcaaccgtcaaccgctctggtcttacccccggcttgatatccaatttttctaagaccgccattaatctagcctttgtatcctcttctttaccataaattcccatcaagttattccacaacgtttttctccgatgcgcaaaacatccatgcaccgtcttataaaacgcatctttcgaatatggctgtacctttcttggctcacgatgcgtcaacttcacaattgccgaatccacctttggtcgcggcataaacgcttcctttagcacgtcaaattcaatattcacattcaaatccaactgcaccgccacactcaatgaaccatatggctttgttcctggcaccgcattaagacgatccgccacctctttttgcatcataaccacaatctgatccaatggtagtgtgctttgcaacaacccctttaaaattggcgttgtaatataatatggcaaattagccaccacttttaaagtatgtttgccatccaaattttctgcaaccacttttggcaaattaaccttcaaaatatctgcattaataattgtgacatttttgtaaggatccagtgtttcgtccaatacatccaacaagttttcatcaatctcaaacgccaacacgtggtgagcatgacgcgccaactgctccgttaacgctccaattccgggtcccacttcgatcacatcatcttcctcagaaatatcggcagctgccacgatatccttcaaaatttgtggtctagtcaaaaagttttgacctaaactctttttagcgtttaagccgtaacgttccaagattgcccgtgtccgaactggatctgcaatatcaatttcttgtgtcatttcttactccttatttttgatctaattcatctactgccgcttgaaaagcctcacgactcacctgaaacagttgaagtctctttactaactgttttccattcacataaccaatattcagaatttcacacaactccatacgccgctgtttggcgtgggtccctgcaattaagtcagcgtccagtaaatcatccctggtaatctgcaatggtgcatcagcagcctctgtatacactttacctagggcttctcgaataacttcaggggtcgcatgttccacgcctaaactcccctttttactgggcactgcatcccttctcgccaaaaacgcatgctttacatccggaacctcagccgaaatggtcttgcggattttttcaccggaaaagtcgggatccgtaaacacaataacaccgcgttctgcttgtaaacgccgaatttgttcaatcgtttcttcagaaattgcagatcctcgtgtctctagggtatccgcgtttaccgctttttttatccgaacagtatcatcttttccttcaactacaataacttctttaatttttttcatcatcgtctatcctataaaattgtttggcattttcatacgttgctttgcctgtgacatcaggatcttcatcccgcaaacgggccaacgcttcaaccacataaagtgtgtaggcaggctcattttgttttcctctaaaaggaatgggggccagatacggggcatctgtttccgccataatccgatctgccggtgtttcttgcacagatttatgcacatcatgggcagaattaaaacttgcaacaccactgtatgagatatgcatcccaagtgccaaaaatttatcaagccactctggtccgccattgaagctgtgcatcacaccaccaaagttttctacatgcgcattttttaaaatcgcatacgtatcttcaaaagcatcccgattatgaattgcaaccgggatatgaaccttacttgccagctccaattgttcttcaaatacccgccgttgaatttttcgcggcgattttgtttcataataatccaggccaatttcacccaaagcaaccactttcgagtcctgtaattgtgctcgtaaaatttctgcttggtcttcatgaaaatacttagaatcttctggatgccatccaactacggcatagatatcttcatattggtgcgcaagtttaattgcggatgcattaaattcagcatttgagcccaccattgccattttttggatacctaacttatgagcatgttcaatataagctttctcatgtcccaaaaaagccggatcattcaaatgcgtatgtgaatcaaatagttgcatgtttacctccaattatcaaaaaccaacccaagacaccgcaaactgttcacttggtcttagattggtctttacattatcatcatgttttacaaaatcaacttattcaactccagaaccattaaccaaactatttggtacctcaacaacttgaatatgaccatcatgttcagctgatagcaacattccttgactaatttcaccacgcatcttacgaggcttgagattagccacaatcaaaacttttttaccaactagaacgcttggatctggataatattcagcaatcccagaaagaatctggcggtcacctttatcaccagcgtcgagtttaaacttcaaaagtttatcggcaccttcaacgttatccacagatttaatctcagcgaccttaagttctactttatcaaaagcttcaatacggattggctttttagtgatattaagttctgctgcatcctcggtttgtgctgcttttttagcttcttccatggcagcacggcccttctttttatcagttttggtcatttgtgccttgatgaattcgacctcttctttagcgtccaaacgaggaaaaattggggttccttttgcgacaactttagtatccgcaggaatcgttccaaatttcaagtcagctaagtcaactgtttgagcagttaatccgagctgtgccaaaattttacttggagctttcgtcaaaattggctgcaacaaatgcgccaacaaacgtaaactttctgccaagtgattcataacacttgctaatttagcttgatccgcagcgtcatcactcttagccagtacccaaggctgggtttcatcaatatatttgttggagcggctaaccagtttccaaatttcggaaagtgcatctgagaaatgaagagaattcattaattcgcggt
